United States Patent
Borges et al.

(10) Patent No.: US 11,999,800 B2
(45) Date of Patent: Jun. 4, 2024

(54) BISPECIFIC AND TETRAVALENT CD137 AND FAP MOLECULES FOR THE TREATMENT OF CANCER

(71) Applicant: Boehringer Ingelheim International GmbH, Ingelheim am Rhein (DE)

(72) Inventors: Eric Borges, Biberach (DE); Pankaj Gupta, Scarsdale, NY (US); Daniel Christopher Rowe, Ridgefield, CT (US); Justin M. Scheer, Ridgefield, CT (US); Abdallah Souabni, Vienna (AT); Inigo Tirapu, Vienna (AT); Joseph Ronald Tumang, Danbury, CT (US)

(73) Assignee: Boehringer Ingelheim International GmbH, Ingelheim am Rhein (DE)

( * ) Notice: Subject to any disclaimer, the term of this patent is extended or adjusted under 35 U.S.C. 154(b) by 0 days.

(21) Appl. No.: 17/323,844

(22) Filed: May 18, 2021

(65) Prior Publication Data
US 2021/0363273 A1    Nov. 25, 2021

Related U.S. Application Data

(60) Provisional application No. 63/037,241, filed on Jun. 10, 2020, provisional application No. 63/026,883, filed on May 19, 2020.

(51) Int. Cl.
| | |
|---|---|
| *C07K 16/40* | (2006.01) |
| *A61K 39/00* | (2006.01) |
| *A61P 35/00* | (2006.01) |
| *C07K 16/28* | (2006.01) |

(52) U.S. Cl.
CPC ........... *C07K 16/40* (2013.01); *A61P 35/00* (2018.01); *C07K 16/2878* (2013.01); *A61K 2039/507* (2013.01); *C07K 2317/31* (2013.01); *C07K 2317/565* (2013.01); *C07K 2317/622* (2013.01)

(58) Field of Classification Search
None
See application file for complete search history.

(56) References Cited

U.S. PATENT DOCUMENTS

| | | | |
|---|---|---|---|
| 4,676,980 A | 6/1987 | Segal et al. |
| 4,689,405 A | 8/1987 | Frank et al. |
| 4,946,778 A | 8/1990 | Ladner et al. |
| 5,260,203 A | 11/1993 | Ladner et al. |
| 5,731,168 A | 3/1998 | Carter et al. |
| 6,210,669 B1 | 4/2001 | Aruffo et al. |
| 7,288,638 B2 | 10/2007 | Jure-Kunkel et al. |
| 7,659,384 B2 | 2/2010 | Jure-Kunkel et al. |
| 8,008,449 B2 | 8/2011 | Korman et al. |
| 8,137,667 B2 | 3/2012 | Jure-Kunkel et al. |
| 8,337,850 B2 | 12/2012 | Ahrens et al. |
| 8,354,509 B2 | 1/2013 | Carven et al. |
| 8,475,790 B2 | 7/2013 | Jure-Kunkel |
| 8,507,656 B2 | 8/2013 | Bedian et al. |
| 8,568,727 B2 | 10/2013 | Adolf et al. |
| 8,821,867 B2 | 9/2014 | Ahrens et al. |
| 8,999,342 B2 | 4/2015 | Renner et al. |
| 9,340,609 B2 | 5/2016 | Brinkmann et al. |
| 9,382,328 B2 | 7/2016 | Jure-Kunkel et al. |
| 9,404,125 B2 | 8/2016 | Harriman et al. |
| 9,468,678 B2 | 10/2016 | Ahrens et al. |
| 9,494,125 B2 | 11/2016 | Pham et al. |
| 9,494,926 B2 | 11/2016 | Frazer et al. |
| 9,758,589 B2 | 9/2017 | Kohrt et al. |
| 10,137,202 B2 | 11/2018 | Kontermann et al. |
| 10,174,122 B2 | 1/2019 | Kwon et al. |
| 10,259,881 B2 | 4/2019 | Gray et al. |
| 10,265,357 B2 | 4/2019 | Laer et al. |
| 10,279,038 B2 | 5/2019 | Bobrowicz et al. |
| 10,350,292 B1 | 7/2019 | Bobrowicz et al. |
| 10,526,413 B2 | 1/2020 | Amann et al. |
| 10,537,590 B2 | 1/2020 | Oost et al. |
| 10,640,568 B2 | 5/2020 | Ahrens et al. |
| 11,447,558 B2* | 9/2022 | Ferrara Koller ........ A61P 31/00 |
| 2004/0132028 A1 | 7/2004 | Stumpp et al. |
| 2013/0244940 A1 | 9/2013 | Steiner et al. |
| 2016/0369000 A1 | 12/2016 | Ahrens et al. |
| 2017/0114141 A1 | 4/2017 | Amann et al. |
| 2017/0174774 A1 | 6/2017 | Coric et al. |
| 2017/0247467 A1 | 8/2017 | Amann et al. |
| 2017/0369592 A1 | 12/2017 | Brokopp et al. |
| 2018/0011884 A1 | 1/2018 | Sos-Munoz et al. |
| 2018/0118836 A1 | 5/2018 | Bernett et al. |
| 2018/0118841 A1 | 5/2018 | Ellmark et al. |

(Continued)

FOREIGN PATENT DOCUMENTS

| | | |
|---|---|---|
| CA | 3075337 | 4/2019 |
| EP | 0307434 A1 | 3/1989 |

(Continued)

OTHER PUBLICATIONS

Lu et al (Construction and Production of an IgG-Like Tetravalent Bispecific Antibody, IgG-Single-Chain Fv Fusion, Human Monoclonal Antibodies, p. 185-213, Jan. 2013), (Year: 2013).*

(Continued)

*Primary Examiner* — Laura B Goddard
*Assistant Examiner* — Sarah A Alsomairy
(74) *Attorney, Agent, or Firm* — Kenneth J. Kalafus

(57) ABSTRACT

This invention relates to binding molecules that bind specifically to CD137 and FAP and their use in medicine, pharmaceutical compositions containing the same, and methods of using the same as agents for treatment and/or prevention of cancer.

48 Claims, 31 Drawing Sheets

Specification includes a Sequence Listing.

(56) References Cited

U.S. PATENT DOCUMENTS

| | | |
|---|---|---|
| 2018/0328329 A1 | 11/2018 | Koshimoto et al. |
| 2018/0344870 A1 | 12/2018 | Xiao et al. |
| 2019/0015508 A1 | 1/2019 | Bobrowicz et al. |
| 2019/0019429 A1 | 1/2019 | Palberg et al. |
| 2019/0031765 A1 | 1/2019 | Long et al. |
| 2019/0037711 A1 | 1/2019 | Hong et al. |
| 2019/0055314 A1 | 2/2019 | Luo et al. |
| 2019/0060454 A1 | 2/2019 | Bobrowicz et al. |
| 2019/0211113 A1 | 7/2019 | Amann et al. |
| 2019/0218311 A1 | 7/2019 | Loew et al. |
| 2019/0224315 A1 | 7/2019 | Bobrowicz et al. |
| 2019/0338049 A1 | 11/2019 | Tuna et al. |
| 2020/0071411 A1 | 3/2020 | Amann et al. |

FOREIGN PATENT DOCUMENTS

| | | |
|---|---|---|
| EP | 2509627 A1 | 10/2012 |
| EP | 3470428 | 10/2017 |
| EP | 3445788 A1 | 2/2019 |
| EP | 3470426 A1 | 4/2019 |
| EP | 3470428 A1 | 4/2019 |
| EP | 19201200 | 10/2019 |
| WO | 198801649 A1 | 3/1988 |
| WO | 1988001649 A1 | 3/1988 |
| WO | 199005144 A1 | 5/1990 |
| WO | 199117271 A1 | 11/1991 |
| WO | 1993005804 A1 | 4/1993 |
| WO | 9308829 A1 | 5/1993 |
| WO | 199404678 A1 | 3/1994 |
| WO | 199413804 A1 | 6/1994 |
| WO | 199429348 A2 | 12/1994 |
| WO | 199825971 A1 | 6/1998 |
| WO | 199848837 A1 | 11/1998 |
| WO | 1999057151 A2 | 11/1999 |
| WO | 2001068708 A2 | 9/2001 |
| WO | 200179258 A1 | 10/2001 |
| WO | 2002056910 A1 | 7/2002 |
| WO | 2002083171 A2 | 10/2002 |
| WO | 2003050531 A2 | 6/2003 |
| WO | 2004003019 A2 | 1/2004 |
| WO | 2004041865 A2 | 5/2004 |
| WO | 20040411865 | 5/2004 |
| WO | 2004081026 A2 | 9/2004 |
| WO | 2006121168 A1 | 11/2006 |
| WO | 2007042309 A2 | 4/2007 |
| WO | 2007077173 A1 | 7/2007 |
| WO | 2009089004 A1 | 7/2009 |
| WO | 2009101611 A1 | 8/2009 |
| WO | 2009114335 A2 | 9/2009 |
| WO | 2010040526 A1 | 4/2010 |
| WO | 2012032433 A1 | 3/2012 |
| WO | 2012130831 A1 | 10/2012 |
| WO | 2015112900 A1 | 7/2015 |
| WO | 2015118030 A2 | 8/2015 |
| WO | 2015119923 A1 | 8/2015 |
| WO | 2016100882 A1 | 6/2016 |
| WO | 16110598 | 7/2016 |
| WO | 2016109546 A2 | 7/2016 |
| WO | 2016110598 A1 | 7/2016 |
| WO | 2016146260 A1 | 9/2016 |
| WO | 2017019896 A1 | 2/2017 |
| WO | 2017055398 A2 | 4/2017 |
| WO | 2017060144 A1 | 4/2017 |
| WO | 2017077085 A2 | 5/2017 |
| WO | 201794361 A1 | 6/2017 |
| WO | 2017130076 A1 | 8/2017 |
| WO | 2017178653 A2 | 10/2017 |
| WO | 2017182672 A1 | 10/2017 |
| WO | 2017194438 A1 | 11/2017 |
| WO | 2017218707 A2 | 12/2017 |
| WO | 2018055060 A1 | 3/2018 |
| WO | 2018060323 A1 | 4/2018 |
| WO | 2018086985 A1 | 5/2018 |
| WO | 2018091740 A2 | 5/2018 |
| WO | 2018115231 A2 | 6/2018 |
| WO | 2018127473 A1 | 7/2018 |
| WO | 2018127787 A1 | 7/2018 |
| WO | 2018134787 A2 | 7/2018 |
| WO | 2018191502 A2 | 10/2018 |
| WO | 2019014328 A2 | 1/2019 |
| WO | 2019023347 A1 | 1/2019 |
| WO | 2019036855 A1 | 2/2019 |
| WO | 2019037711 A1 | 2/2019 |
| WO | 2019072868 A1 | 4/2019 |
| WO | 2019072870 A1 | 4/2019 |
| WO | 2019086500 A2 | 5/2019 |
| WO | 2019175125 A1 | 9/2019 |
| WO | 2019234220 A1 | 12/2019 |
| WO | 2020068752 A1 | 4/2020 |
| WO | 2020152306 A1 | 7/2020 |
| WO | 2021064137 A2 | 4/2021 |
| WO | 2021236658 A1 | 11/2021 |

OTHER PUBLICATIONS

Cheng, Clin. Cancer Res. Tumors and their micronvironments, vol. 9, 2003.

Kwon, J. of Immunology, Immune Responses in Deficient Mice, 2002.

Narazki, Blood, CD137 agonist antibody prevents cancer recuurence, 2010.

Somekh, CD137 deficiency causes immune dysregualtion with predisposition to lymphomogenesis, 2019.

Fisher, Cancer immunol Immuno, Targeting of 4-1BB by monocolonal antibody PF-05082566 enhances T-cell function, 2012.

Pieris, IN/BRUNS, Combination therapies comprising CD137. HER2 Bispecific agents and PD-1 Axis inhibitors and uses thereof, 2019.

Hinner, Clin. Cancer Research, Tumor Localized Costimulatory T-cell engagement by the 4-1BB/HER2 Bispecific Antibody, vol. 25, 2019.

Sam, A novel Versatile tumor stroma targeted 4-1BB agonist for comn=bination immunotherapy with checkpoint ibhibitors,2018.

Pollock, J. Immunol, Inducible T cell antigen 4-1BB Analysis of ecpression and function, vol. 150, 1993.

Hurtado, J, Immunolgy, Potential Role of 4-1BB in T cell activation, vol. 155, 1995.

Chen, Cobination of 4-1BB Agnonist and PD-1 Antagonist Promotes Anti-tumor Effector, 2015.

Chin, Nature, Structure of the 4-1BB/4-1BBL complex and distinct binding and functional properties of utomilumab and urelumab, 2018.

Li, Cell Reports, Limited Corss linking of 4-1BB by 1-BB Ligand and the Agonist Monoclonal Antibody Utomilumab, vol. 25, 2018.

Segal, Clinical Cancer Research, Phase I study of Single-Agent Utomilumab, 2018.

Chester, Blood, Immunotherapy targeting 4-1BB, 2018.

News in Brief, Enhancing PD-1 Blockade in Solid Tumors, Cancer Discovery DOI: 10.1158/2159-8290.CD-NB2016-086.

Dong, Nature Medicine, Tumor Associated B7-H1 promotes T-cell apoptosis, vol. 8, 2002.

Iwai, ONAS, Involvement of PD-L1 on tumor cells in the escape from host immune ssystem, 2002.

Shin, Current Opinion in Immunology, The evolution of checkpoint blockade as a cancer therapy, vol. 33, 2015.

Tang, Cancer Cell, Facilitating T Cell infiltration in Tumor Microenvironment, vol. 29, 2016.

Valentini, Oncotarget, PD-Li expression in colorectal cancer defines 3 subsets of tumor immune microenvironments, 2018.

Galon, Science, Typen, Density, Location of Immune Cells Within Human Colorectal Tumors Predict Clinical Outcome, 2006.

Hwang, Gynecol Oncology, Prgnostic Significance of tumor infiltrating T cells, 2012.

Mahmoud, Tumor Infiltrating CD8 Lymphocytes Predict Clinical Outcome in Breast Cancer, 2011.

Li, Int. J. Mol. Sci, A mini review for Cancer Immunol, vol. 17, 2016.

(56) References Cited

OTHER PUBLICATIONS

Hamid, New Enlgand J. Of Med., Safety and tumor Responses with Lambrolizumab, vol. 369, 2013.
Deng, MABS, Preclnical pharmacokinetics, pharmacodynamics, 2016.
Boyerinas, Cancer Immunol., Antibody Dependent Cellular Cytotoxicity Activity LEvel of a Novel Anti-PD-L1 Antibody, vol. 3, 2015.
Stewart, Cancer immunol, ID and Pre-clinical Characterization of MEDI14736, vol. 3, 2015.
Ibrahim, Semin, Oncol., PD-L1 Blockade for Cancer Treatment, 2015.
Traunecker, EMBO, Bispecific single chain molecules, 1991.
Brennan, Science, Preparation of bispecic antibodies by chemical recombination of monoclonal immunoglobulin G1 fragments, vol. 229, 1985.
Kostelny, Immunol., Formation of a bispecific antibody by the use of leucine zippers, vol. 148, 1992.
Hollinger, PNAS, Diabodies, vol. 90, 1993.
Gruber, Immunol., Efficient tumor cell lysis mediated by a bispecific single chain antoibody, vol. 152, 1994.
Tutt, Immunol, Trispeciifc F(ab) 3 derivatives that use cooperative signaling via the TCR/CD3 complex and CD2, 1991.
Al-Lazikani, JMB, Standard Conformations for the canonical structure of immunoglobulins, 1997.
MacCallum, J. Mol. Biol, Antibody Antigen interactions, vol. 262, 1996.
Lefranc, Dev. Comp. Immunol., IMGT unique numbering for immunoglobulin, 2003.
Honegger, J. Mole Biol., Yet Another Numbering scheme for Immunoglobulin variable domains, vol. 209, 2001.
Boakle, Nature, An IgG primary sequence exposure theory for complement activation using synthetic peptides, 1979.
Lukas, J. Immunol, Inhibition of C-1 mediated immune hemolysis by mononumeric and dimeric peptides, vol. 127, 1981.
Brunhouse, Mol. Immunol., Isotypes of IGG: Comparison of the primary structures fo 3 pairs of isotypes, vol. 16, 1979.
Burton, Nature, The C1q receptor site on immunoglobulin G, vol. 288, 1980.
Thommesen, Mol. Immunol., Lysine 322 in the human IgG3 CH2 domain is critical for antibidy dependent complement activation, vol. 37, 2000.
Idusogie, J. Immunol., Mapping fo the C1q Binding site on Rituxan, vol. 164, 2000.
Hezareh, J. Virology, Effector Function Activities of a panel of mutants of a broadly Neutralizing Antibody, vol. 75, 2001.
Morgan, Immunol., The n-terminal end of the CH2 domain of chimeric human IgG1 anti-HLA-DR is necessary for C1q, Fc gamma R1, 1995.
Billetta, Int. Rev. Immunol., Chimeric Antibodies, 1993.
Marks, J. Mol. Biol, By-passing immunisation, 1991.
Claus, Christina, et al. "Tumor-targeted 4-1BB agonists for combination with T cell bispecific antibodies as off the shelf therapy" (2019) Science Translational Medicine, 11, 1-12.
Idusogie, Esohe, et al. "Mapping of the C1q Binding Site on Rituxan, a Chimeric Antibody with a Human IgG1 Fc" (2000) Journal of Immunology, vol. 164, 4178-4184.
International Search Report and Written Opinion for PCT/US2021/032990 dated Nov. 16, 2021.
Konishi, Eiji et al. "Utilization of Complement-Dependent Cytotoxicity to Measure Low Levels of Antibodies: Application to Nonstructural Protein 1 in a Model of Japanese Encephalitis Virus" (2008) Clinical and Vaccine Immunology, vol. 15, No. 1, 88-94.
Venkataramani, Sathyadevi et al. "Design and characterization of Zweimab and Doppelmab, high affinity dual antagonistic anti-TSLP/IL 13 bispecific antibodies" (2018) Biochem and Biosearch Communications, 19-24.
Knappilk, J. Mol. Biol, Fully Synthetic Human Combinatatorial Antibody Libraries, 2000.
Carmen, Briefings in Funactional Genomics, Concepts in antibody Phage display, 2002.

Lonberg, Int. Rev. Immunol, Human antibodies from transgenic mice, 1995.
Bruggeman, CurrentOpinion Biotech., Production of human antibody repertoires in transgenic mice, 1997.
Huston, Int. Review of Immunol., Medical Applications of Single Chain antibodies, vol. 10, 1993.
Revets, Expert Opin. Biol, Nanobodies as novel agents for cancer therapy, 2005.
Srinivasan, Current Protein Pept Sci., Immunomodulatory Peptides, 2005.
Malmqvist, Curre. Opin. immunol. Surface Plas resonance for detection of antibody-antigen affinity and kinetics, 1993.
Darling, Assay and Drug Development, Kinetic exclusion assay technology, 2004.
Barbas, Proc. Nat. Acad., Sci, In Vitro evolution of a neutralizing human antibody, 1994.
Schier, Gene, ID of functional and structual amino-acid residues bu parsimonius mutagenesis, 1995.
Orlandi, Proc. Natl, Acad., Sci, Cloning immunoglobulin variablke domains for expression, 1989.
Kohler and Milstein, Nature, Continuous Cultures of fused cells secreting antibody of predefined specificty, 1975.
Kozbor, J. Immunol Methods, Specific immunoglobulin production and enhanced tumorgenicity, 1985.
Norderhaug, J. Immunol Methods, Versatile vectors for transient and stable expression of recombinant antibody molecules, 1997.
Cote, Proc. Natl. Acad. Sci., Genreation of human monoclonal antibodies, 1983.
Cole, Mol. Cell Biology, Human monoclonal antibodies, vol. 62, 1984.
Stemmer, Bio Tech., USing recombination to search more efficiently and throughly, 1995.
Ye, Allele specific apmplification by tetra primer PCR, 1992.
Karlin, Proc. Natl Acad sci., Methods for assessing the statistical significance of milecular sequence features by using general scoring schemes, 1993.
Altschul, Nucleic Acids Res, Gapped BLST and PSI-BLAST, 1997.
Torelli, Computer Appl. Biosci, Advance and Adam, vol. 10, 1993.
Pearson, Proc. Natl. Acad. Sci, Improved Tools for Biological sequence comparison, 1988.
Higgins, Methids Enzol., Using Clustal for multiple sequence alignments, 1996.
Kipriyanov, Curr. Opin. Drug Discovery, Recent Advance in the Generation of the Bispecific Antibodies for Tumor Immunotherapy, 2004.
Andris-Widhopf, J. Immuno Methods, Methods for the generation of chicken monoclonal antibody fragments, 2000.
Burton, ilmunotechnology, Phage display, 1995.
Bird, Science, Single Chain antigen binding proteins, 1988.
Huston, Proc. Natl Acad, Sci, Protein engineering of antibody sites, 1988.
Skerra, Science, Assembly of a functional immunoglobulin Fv fragment in *Escherichia colu*, 1988.
Umana, Sci Trans Med, tumor targeted 4-1BBagonists, 2020.
Myers, Bioinformatics, Optical alignments in linear space, vol. 4, 1988.
Umana, Sci Transl, Med, Tumor targeted 4-1BBagonists, vol. 11, 2019.
Altschul, Stephen F. et al. "Basic Local Alignment Search Tool" (1990) Journal Molecular Biology, 215, 403-410.
CAS Reg No. 946414-94-4; SciFinder, 4 pgs, retrieved on Nov. 13, 2023.
Claus, Christina et al. "The emerging landscape of novel 4-1BB (CD137) agonistic drugs for cancer immunotherapy" (2023) MABS, vol. 15, No. 1, 1-23.
Karlin, Samuel et al. "Applications and statistics for multiple high-scoring segments in molecular sequences" (1993) Proc. Natl. Acad. Sci. USA, vol. 90, 5873-5877.
Karlin, Samuel et al. "Methods for assessing the statistical significance of molecular sequence features by using general scoring schemes" (1990) Proc. Natl. Acad. Sci. USA, vol. 87, 2264-2268.

(56) References Cited

OTHER PUBLICATIONS

MacCallum, Robert M. et al. "Antibody-antigen Interactions: Contact Analysis and Binding Site Topography" (1996) Journal Molecular Biology, 262, 732-745.

Marks, James D. et al. "By-passing Immunization Human Antibodies from V-gene Libraries Displayed on Phage" (1991) J. Mol. Biol., 222, 581-597.

Milstein, C. et al. "Hybrid hybridomas and their use in immunohistochemistry" (1983) Nature, vol. 305, 537-540.

NCBI, Database accession No. NP_004451; prolyl endopeptidase FAP isoform 1 [Homo sapiens], https://www.ncbi.nlm.nih.gov/protein/NP_004451.2/., 4 pgs, retrieved Nov. 13, 2023.

NCBI, Reference Sequence: NP_001552.2 tumor necrosis factor receptor superfamily member 9 precursor [Homo sapiens] https://www.ncbi.nlm.nih.gov/protein/NP_001552.2, 4 pgs, retrieved on Nov. 14, 2023.

NCBI, Reference Sequence: NP_032012.1 prolyl endopeptidase FAP [Mus musculus] https://www.ncbi.nlm.nih.gov/protein/NP_032012.1, 4 pgs, retrieved on Nov. 14, 2023.

Sam, Johannes et al. "Abstract 5621: FAP-4-1BBL: A novel versatile tumor-stroma targeted 4-1BB agonist for combination immunotherapy with checkpoint inhibitors, T-cell bispecific antibodies, and ADCC-mediating antibodies" (2018) Cancer Res 78, 13, Supplement, 5621.

Scott, Andrew M. et al. "A Phase I Dose-Escalation Study of Sibrotuzumab in Patients with Advanced or Metastatic Fibroblast Activation Protein-positive Cancer1" (2003) Clinical Cancer Research, vol. 9, 1639-1647.

Torelli, Alberto et al. "Advance and Adam: two algorithms for the analysis of global similarity between homologous informational sequences" (1994) CABIOS, vol. 10, No. 1, 3-5.

UniProt, Database Accession No. P97321, https://rest.uniprot.org/uniprotkb/P97321.txt, 7 pgs, retrieved Nov. 13, 2023.

Uniprot, Database Accession No. Q12884, https://www.uniprot.org/uniprotkb/Q12884/entry, 16 pgs, retrieved Nov. 13, 2023.

UniProt, Database Accession No. F6W5G6_MACMU. "TNF receptor superfamily member 9" https://www.uniprot.org/uniprotkb/F6W5G6/entry, 3 pgs, Retrieved on Nov. 14, 2023.

UniProt, Database Accession No. P20334. TNR9_Mouse "Tumor necrosis factor receptor superfamily member 9", 4 pgs, https://www.uniprot.org/uniprotkb/P20334/entry, Retrieved on Nov. 14, 2023.

UniProt, Database Accession No. Q07011. TNR9_Human. "Tumor necrosiss factor receptor superfamily member 9" 7 pgs, https://www.uniprot.org/uniprotkb/Q07011/entry, Retrieved on Nov. 14, 2023.

Al-Lazikani et al., "Standard Conformations for the Canonical Structures of Immunoglobulins", J. Mol. Biol., 1997, pp. 927-948.

Bonaventura, Paola et al. "Cold Tumors: A Therapeutic Challenge for Immunotherapy" (2019) Frontiers in Immunology, vol. 10, Artice 168, 1-10.

Brunker, Peter et al. "a Novel Tetravalent FAP-DR4 Antibody, Effectively Triggers FAP-Dependent, Avidity-Driven DR5 Hyperclustering and Tumor Cell Apoptosis" (2016) Molecular Cancer Therapeutics, 15 (5), 946-957.

Carmen et al., "Concepts in antibody phage display", Briefings in Functional Genomics, 2002, vol. 1, No. 2, pp. 189-203.

Chen, Siqi et al. "CD73 expression on effector T cells sustained by TGF-b facilitates tumor resistance to anti-4-1bb/CD137 therapy" (2019) Nature Communications, 10, 150, 1-15.

Ching, Kathryn H. et al. "Chickens with humanized immunoglobulin genes generate antibodies with high affinity and broad epitope coverage to conserved targets" (2017) MABS, vol. 1, 1-10.

Jung, In-Hyuk et al. "The Roles of CD137 Signaling in Atherosclerosis" Korean Circulation Journal. 2016 46 (6):753-761.

Kim, Hyung-Don et al. " 4-1BB Delineates Distinct Activation Status of Exhausted Tumor-Infiltrating CD8+ T-cells in Hepatocellular Carcinoma" Hepatology (2020) vol. 71, No. 3, 955-971.

Link et al., "Abstract 2273: Selection of first-in-human clinical dose range for the tumor-targeted 4-1BB agonist MP0310 (AMG 506) using a pharmacokinetic/pharmacodynamics modeling approach", Cancer Research, 2020, vol. 80, No. 16_Supplement, pp. 2273-2273.

Link et al., "Abstract 3752: Preclinical pharmacology of MP0310: A 4-1BB/FAP bispecific DARPin drug candidate promoting tumor-restricted T-cell costimulation", Cancer Research, 2018, vol. 78, No. 13_Supplement, 3752-3752.

Melero et al., "Monoclonal antibodies against the 4-1BB T-cell activation molecule eradicate established tumors", Nature Medicine, 1997, vol. 3, No. 6, pp. 682-685.

Molecular Partners, "Molecular Partners Announces First Patient Dosed in Phase 1 Trial of MP0310, a Novel Tumor-Localized Immunotherapy", Molecular Partners Press Release, 2019, pp. 1-5.

Olofsson, Peter et al. "CD137 is expressed in human atherosclerosis and promotes development of plaque inflammation in hypercholesterolemic mice" Circulation, 2008, 117(10), 1292-12301.

Rettig Wolfgang J, et al. "Regulation and heteromeric structure of the fibroblast activation protein in normal and transformed cells of mesenchymal and neuroectodermal origin" Cancer Research (1993) 53(14):3327-3335.

Riechmann et al., "Reshaping human antibodies for therapy", Nature, 1988, vol. 332, No. 6162, pp. 323-327.

Segal, Neil H. et al. "Results from an Integrated Safety Analysis of Urelumab, an agonist Anti-CD137 Monoclonal Antibody" (2019) American Association for Cancer Research, (23) 8, 1929-1936.

Somekh Ido, et al. "CD137 deficiency causes immune dysregulation with predisposition to lymphomagenesis" Blood (2019) 134(18), 1510-1516.

Tao et al., "The differential ability of human IgG1 and IgG4 to activate complement is determined by the COOH-terminal sequence of the CH2 domain.", The Journal of Experimental Medicine, 1991, vol. 173, No. 4, pp. 1025-1028.

Tolcher et al., "Enhancing PD-1 Blockade in Solid Tumors", Cancer Discovery, 2016, vol. 6, No. 8, pp. 1-4.

Ye, Qunrui, et al. "CD137 accurately identifies and enriches for naturally occurring tumor-reactive T-cells in tumor." (2014) Clinical Cancer Research 20(1): 44-55.

Massarelli, Erminia et al. "Clinical safety and efficacy assessment of the CD137 agonist urelumab alone and in combination with nivolumab in patients with hematologic and solid tumor malignancies" (2016) Journal Immunotherapy for Cancer, 4 (Sup 1), 5-6.

Piha-Paul, Sarina et al. "A Phase 1 Dose Escalation Study of PRS-343, A HER2/4-1BB Bispecific Molecule, in Patients with HER2-Positive Malignancies" Journal Immunotherapy for Cancer, (2020) 8(Sup 1) A-1-12.

Sostoa, Jana de et al. "Targeting the tumor stroma with an oncolytic adenovirus secreting a fibroblast activation protein-targeting bispecific T-cell engager" (2019) Journal Immunotherapy Cancer, 7, 19, 1-15.

Velloso, Garica et al. "Tumor targeting and tissue biodistribution of RO7122290, a novel FAP-targeted 4-1BB (CD137) agonist, in patients with advanced solid tumors, using [89Zr]-RO7122290 as a PET tracer" Society for Immunotherapy of Cancer (2020) 5 pgs.

Ward et al., "Binding activities of a repertoire of single immunoglobulin variable domains secreted from Escherichia coli", Nature, 1989, vol. 341, No. 6242, 544-546.

Winter, Greg et al., "Man made antibodies" (1991) Nature, vol. 349, 293-299.

\* cited by examiner

FIG 1A-B
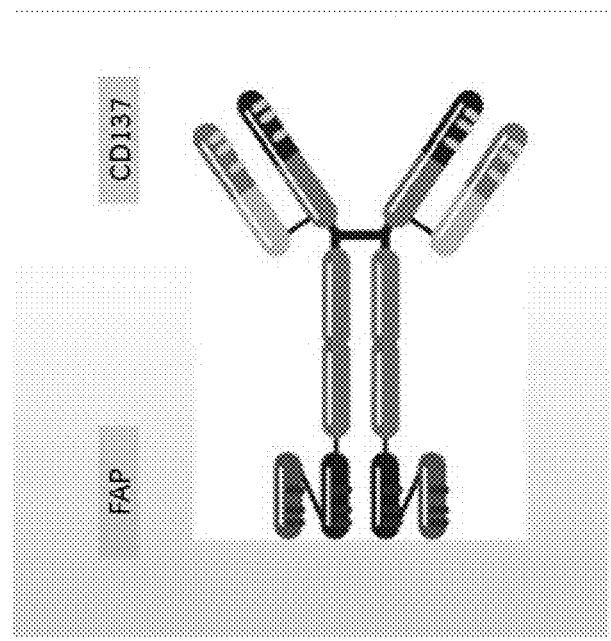
B.
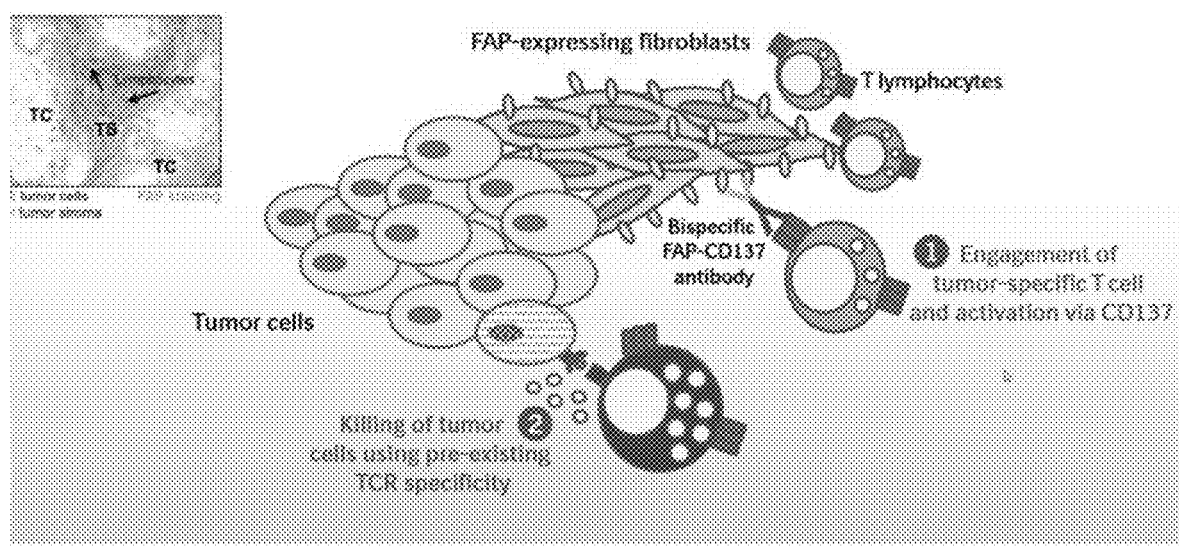

FIG 2A-B
A.
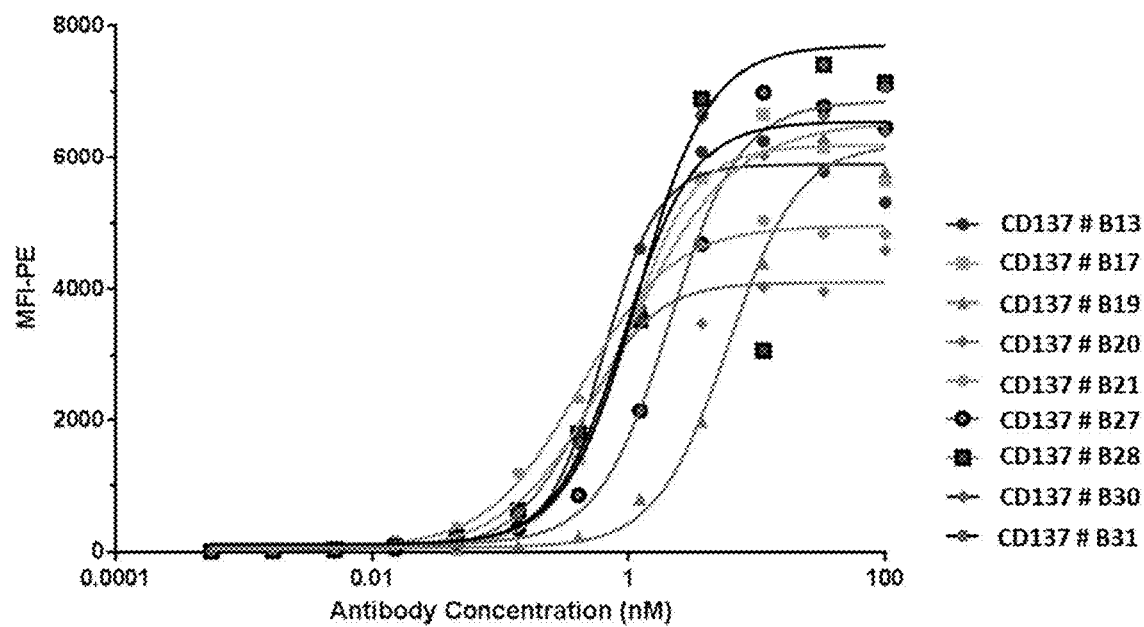
B.
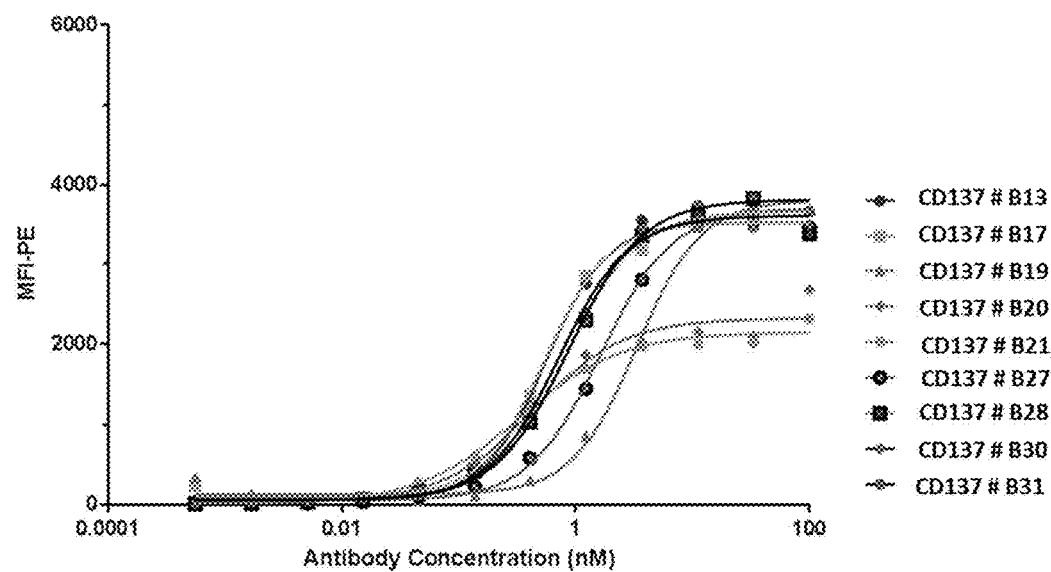

FIG 3A-D
A.
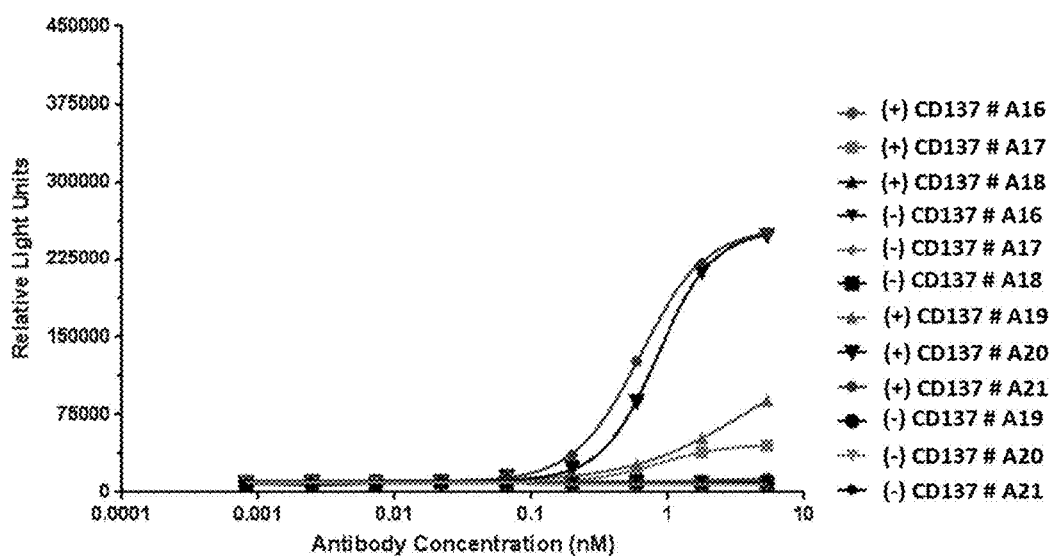
B.
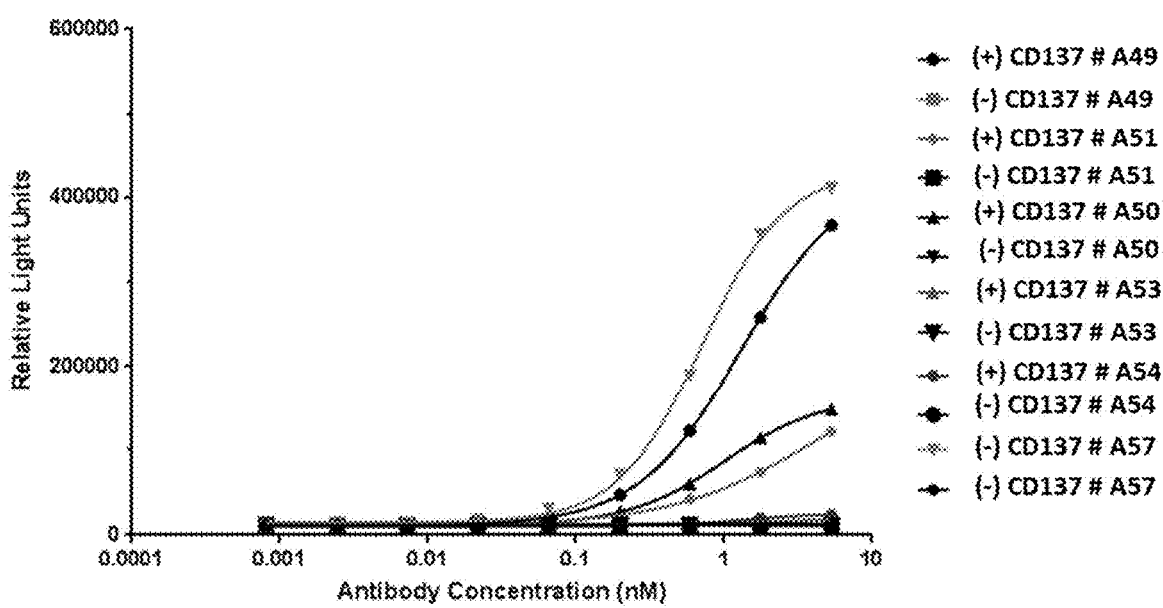

FIG 3A-D, cont.
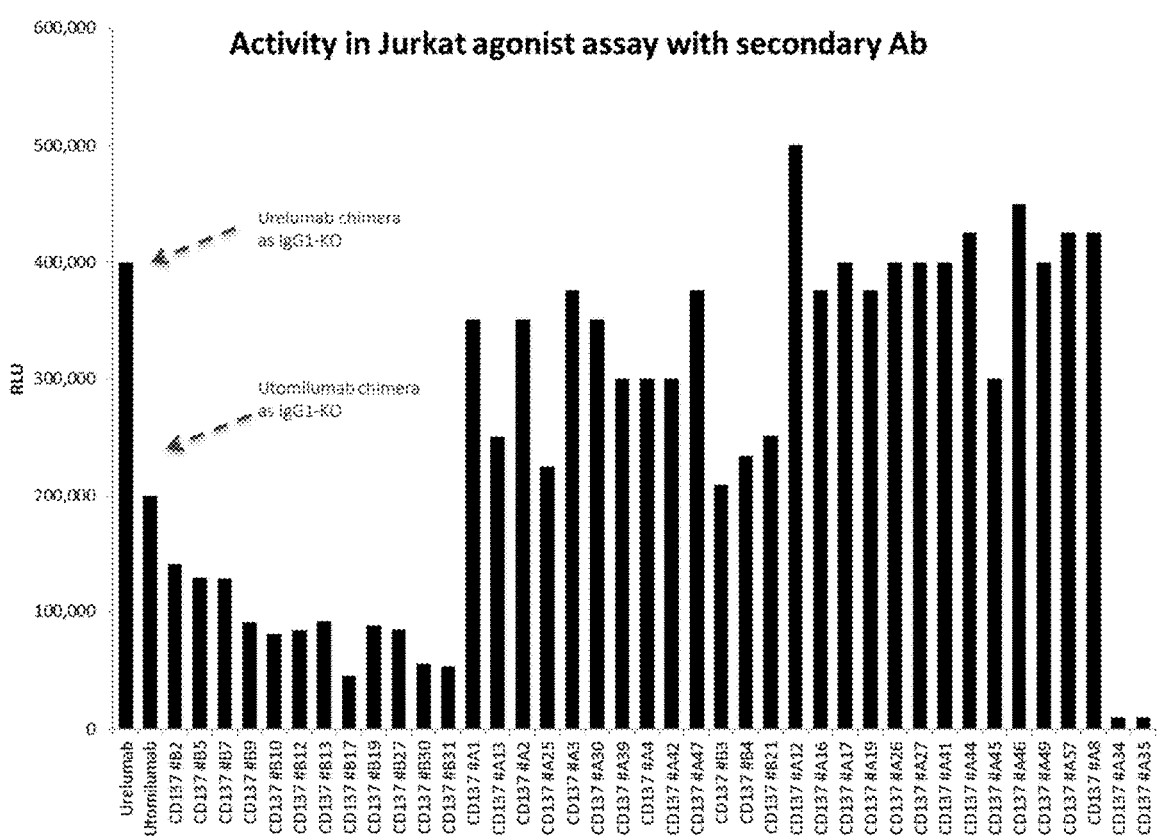

FIG 3A-D, cont.
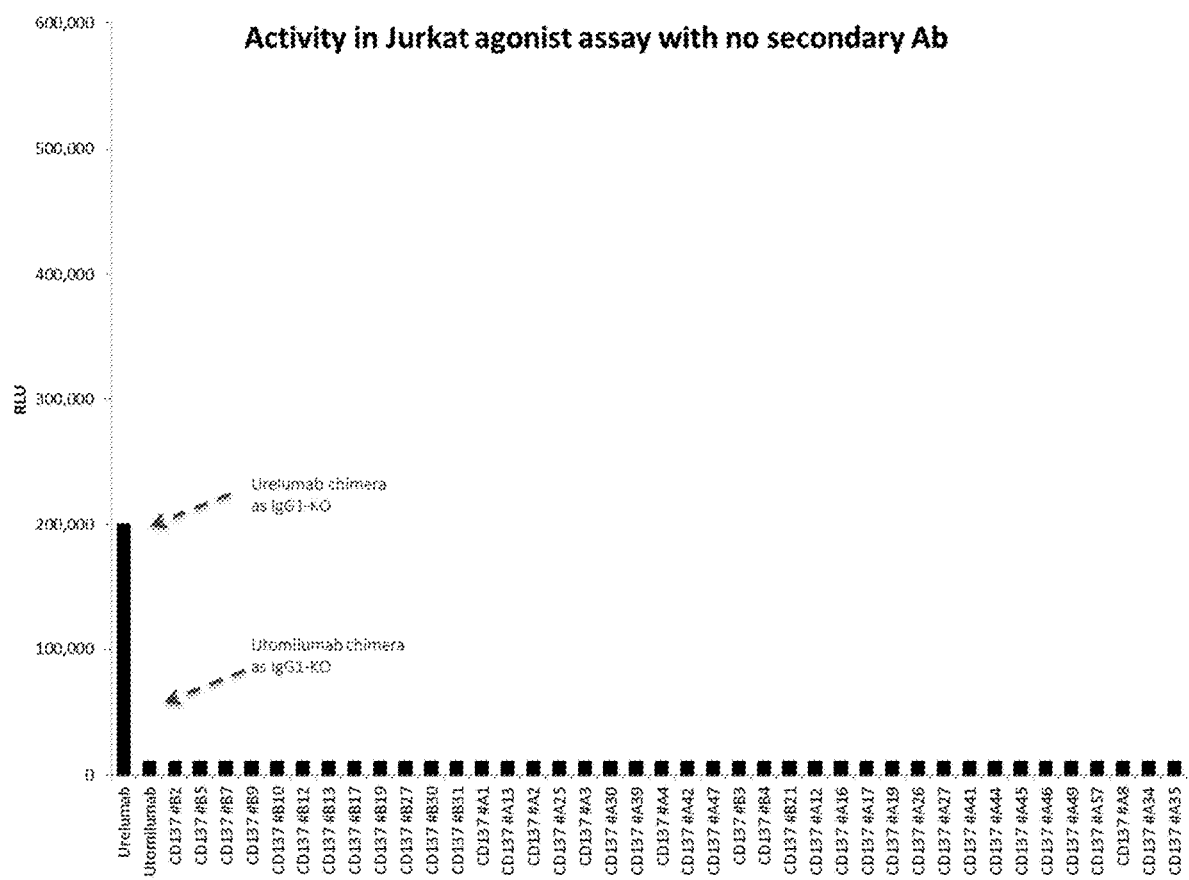

FIG 4A-B
A.
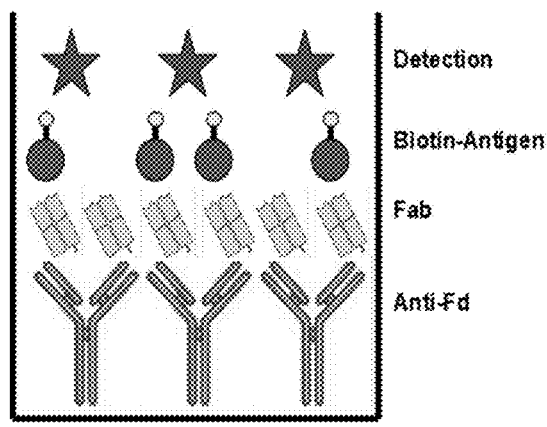
B.
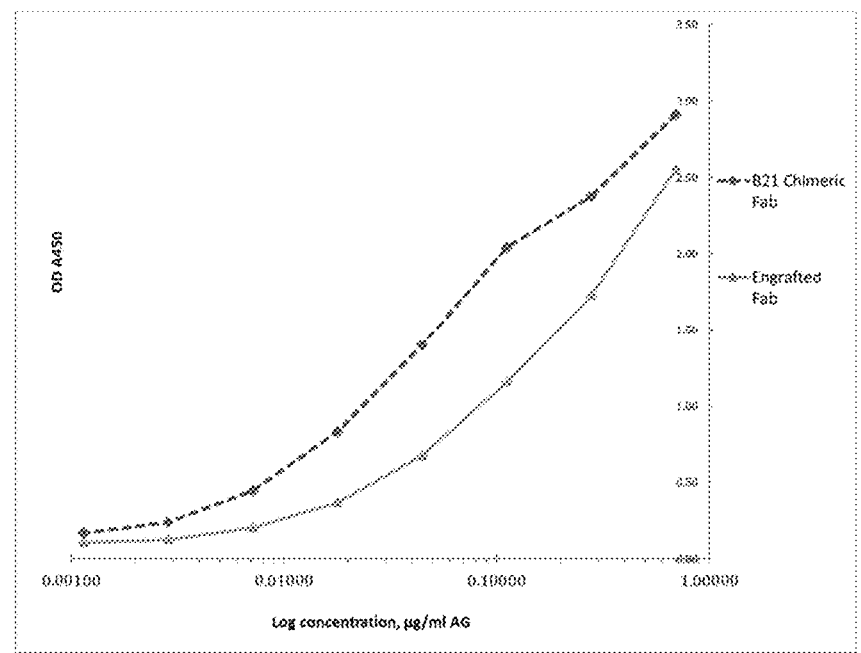

FIG 6A-B
A.
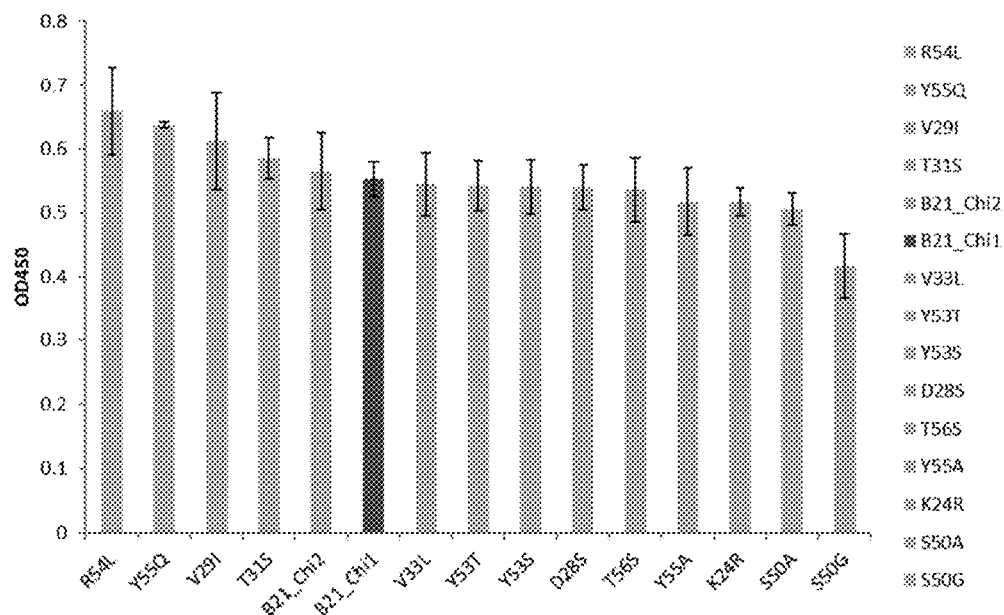
B.
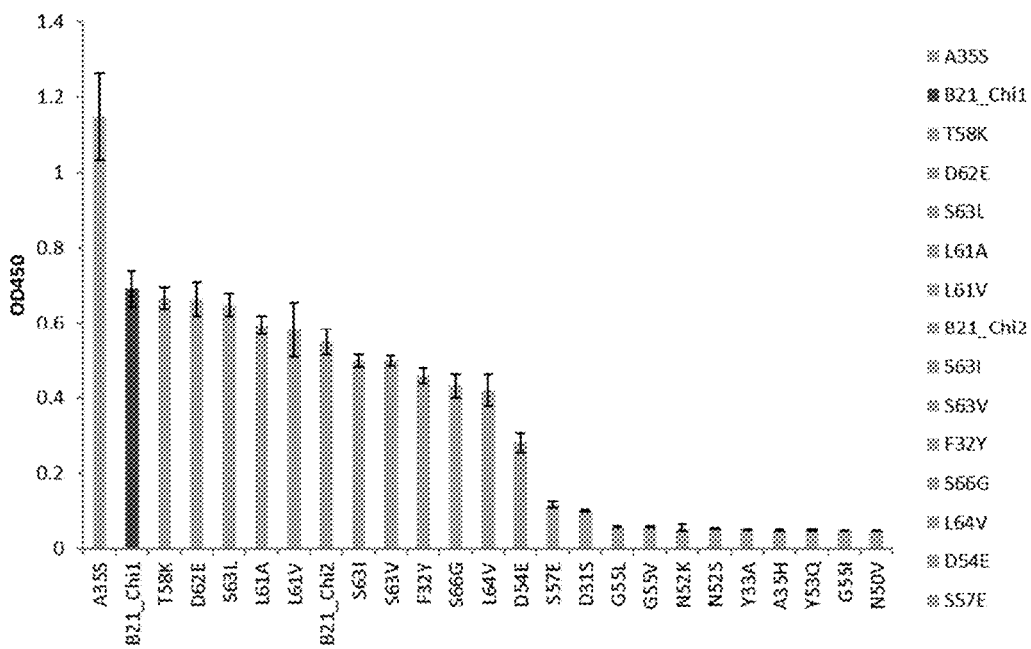

FIG 8A-B
A.
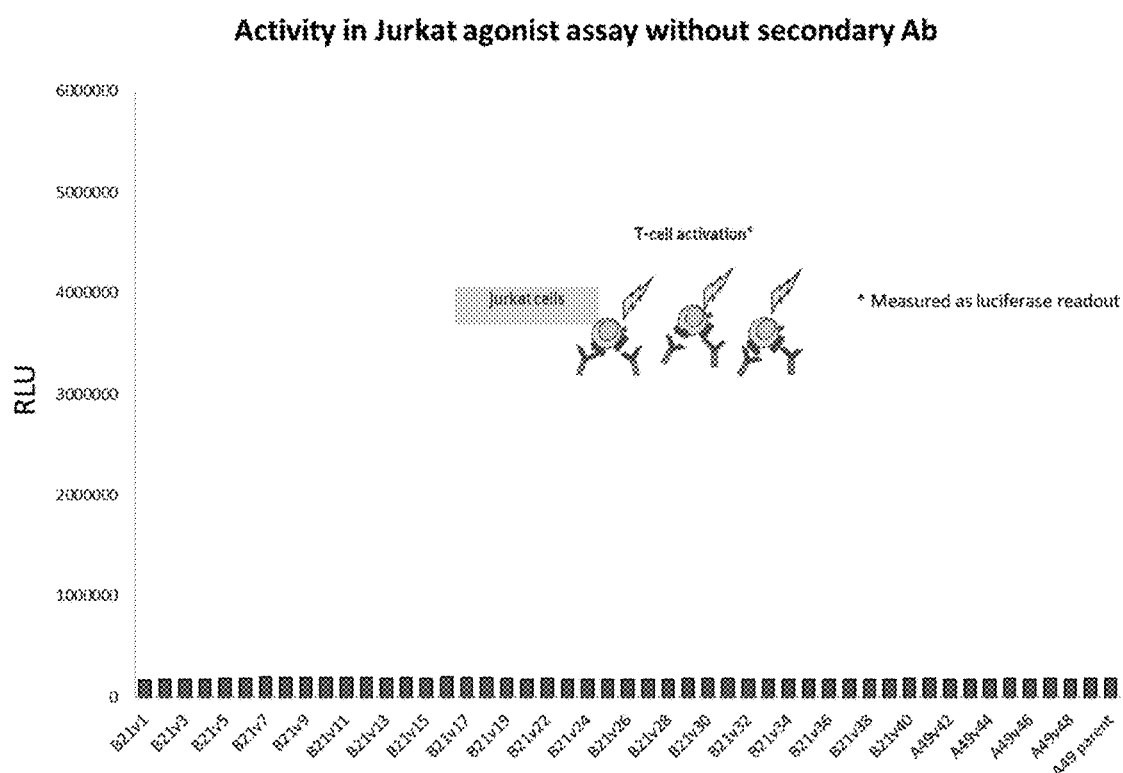

FIG 8A-B cont.
B.
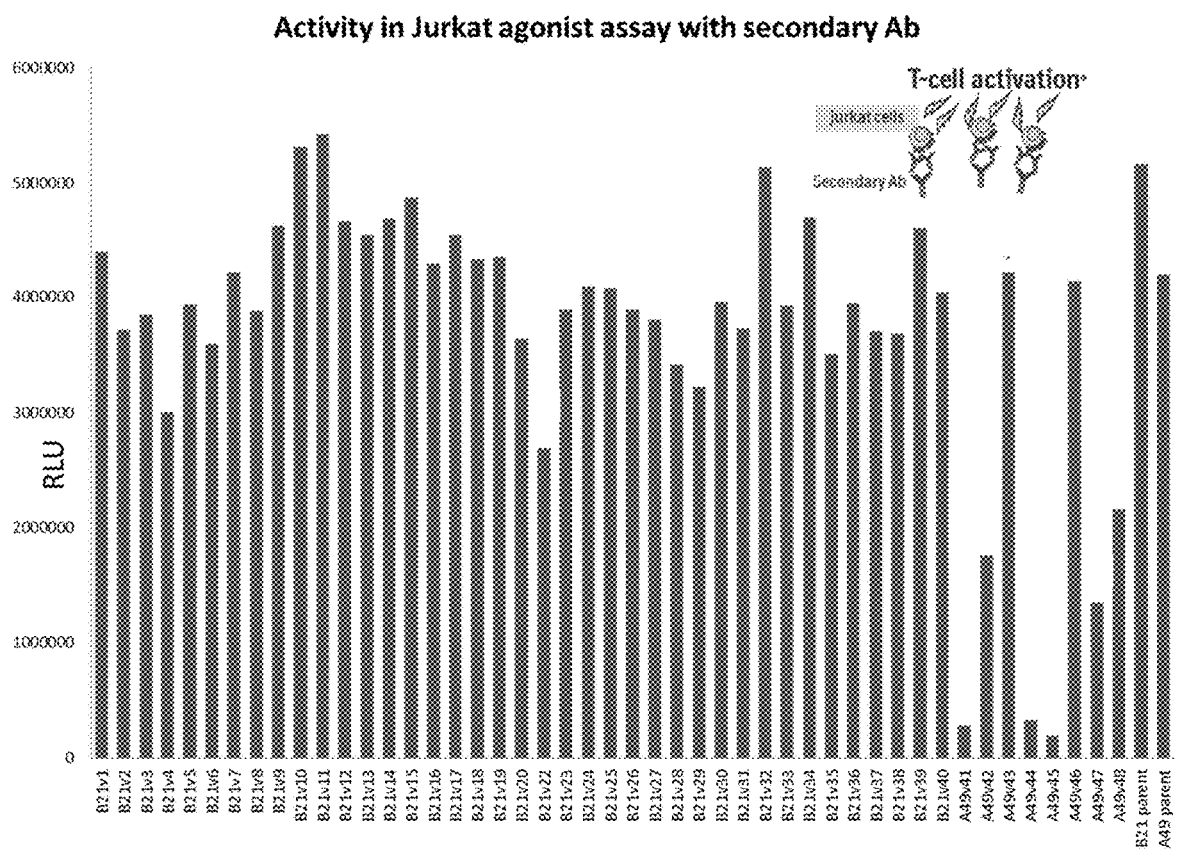

FIG 10A-B
A.
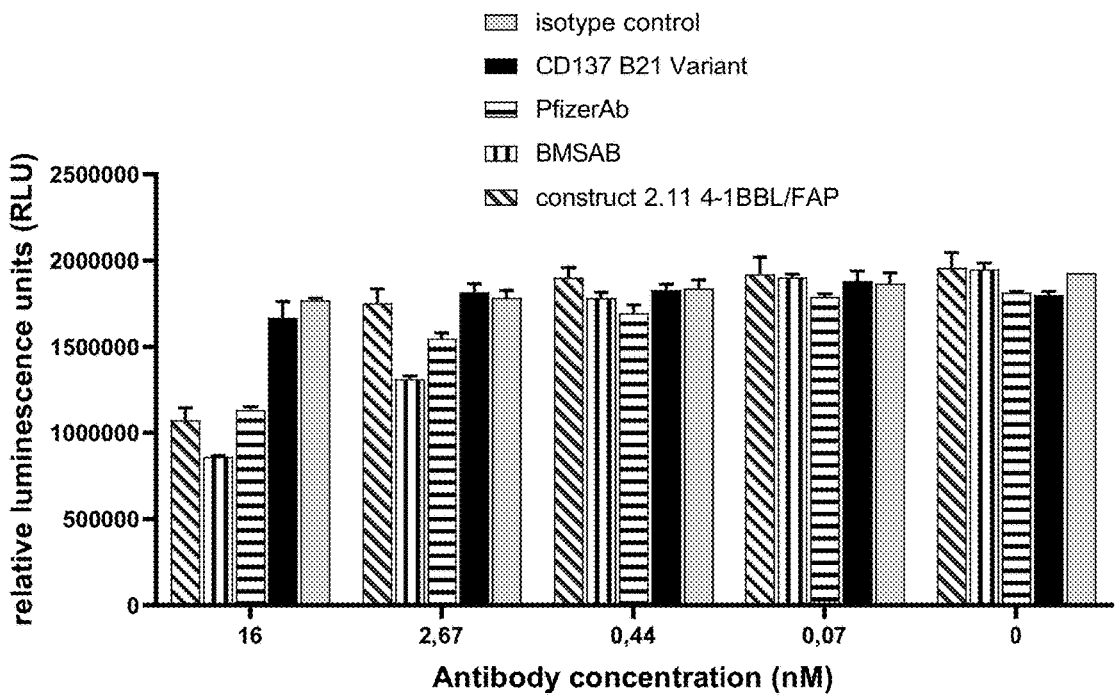
B.
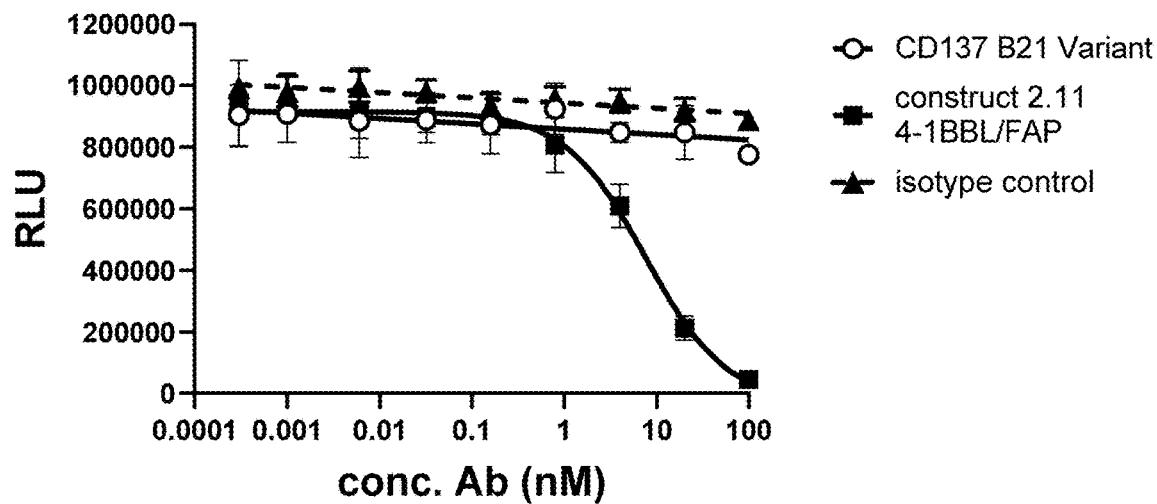

FIG 11A-C
A.
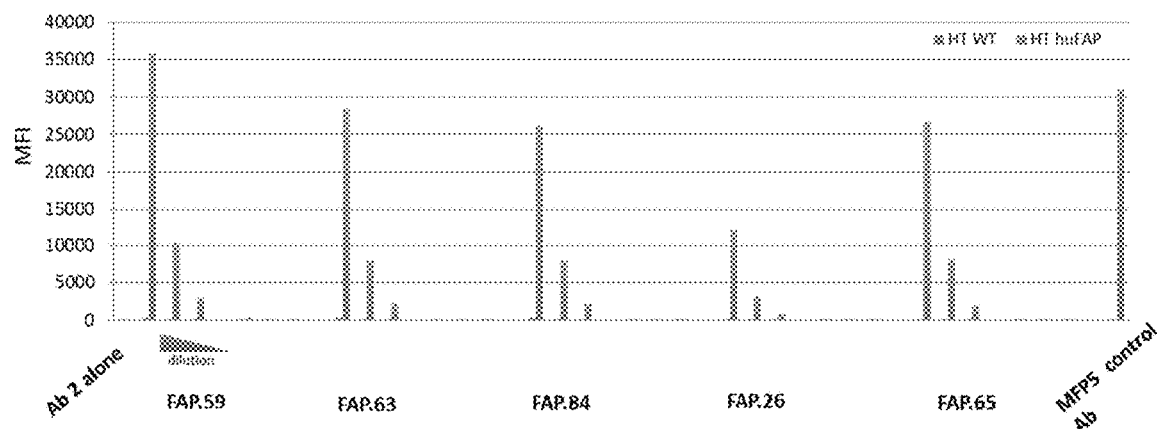
B.
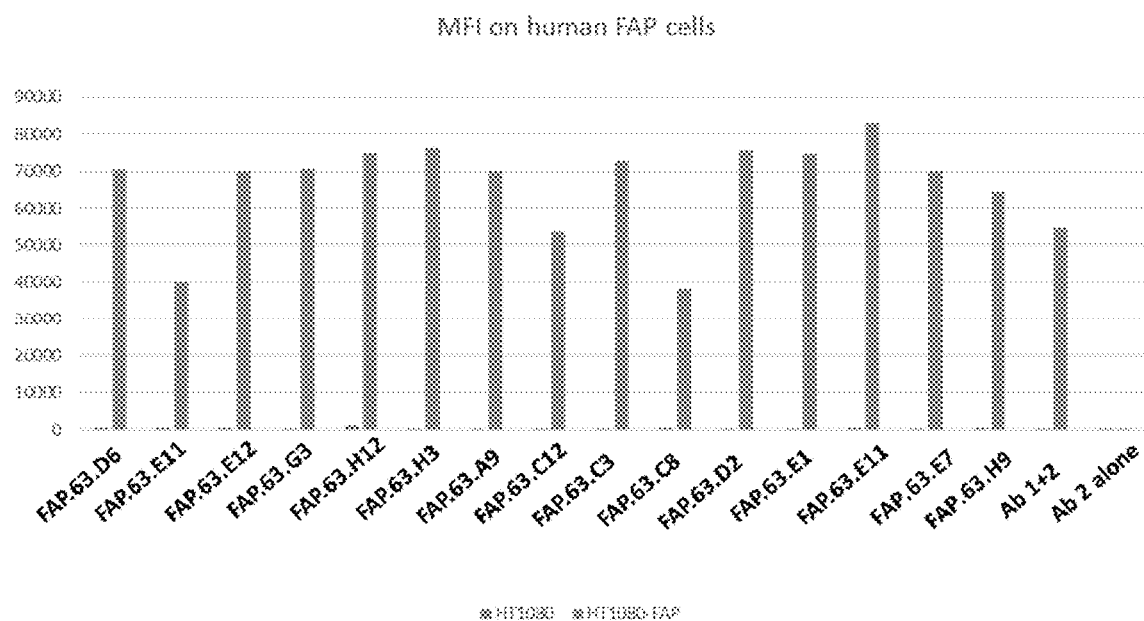

FIG 11A-C cont.
C.
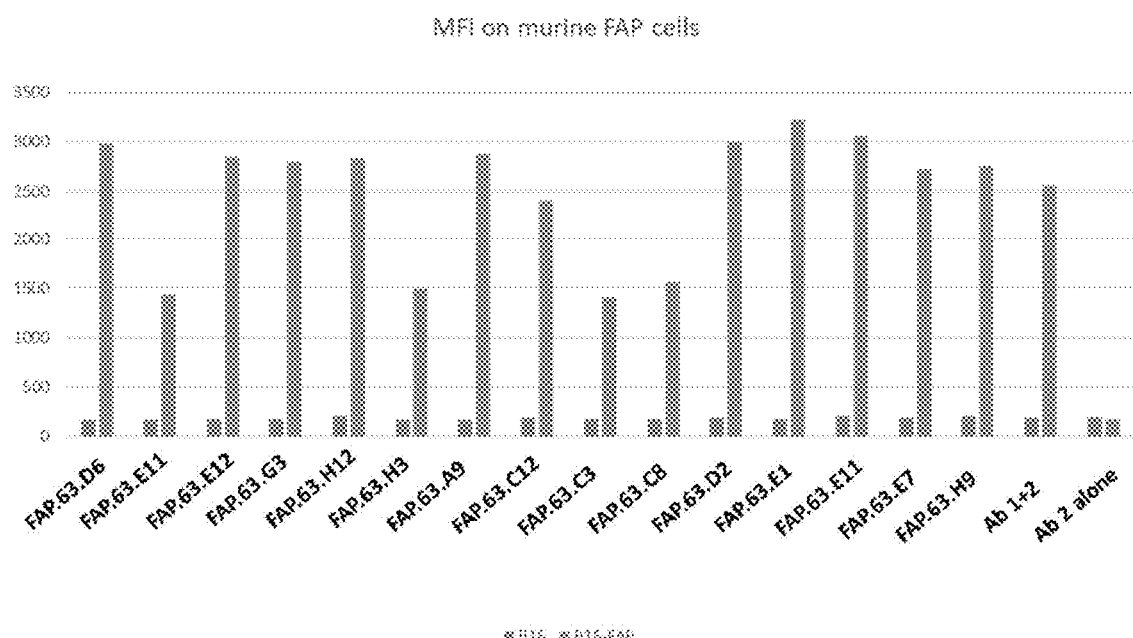

FIG 12A-C
A.
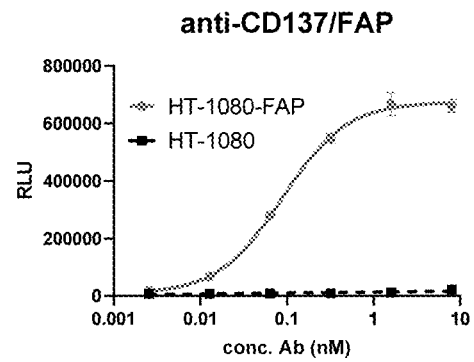
B.
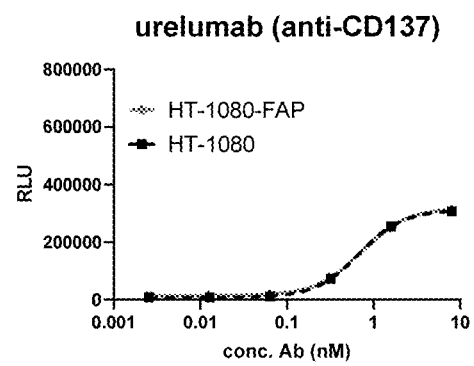
C.
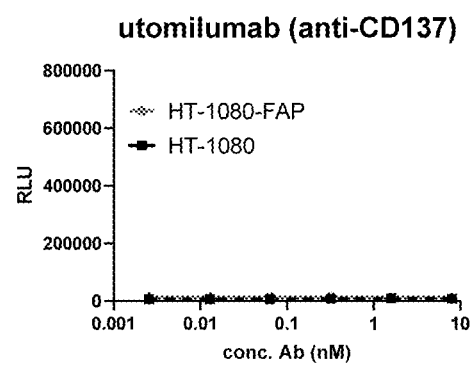

FIG 13A-D
A.
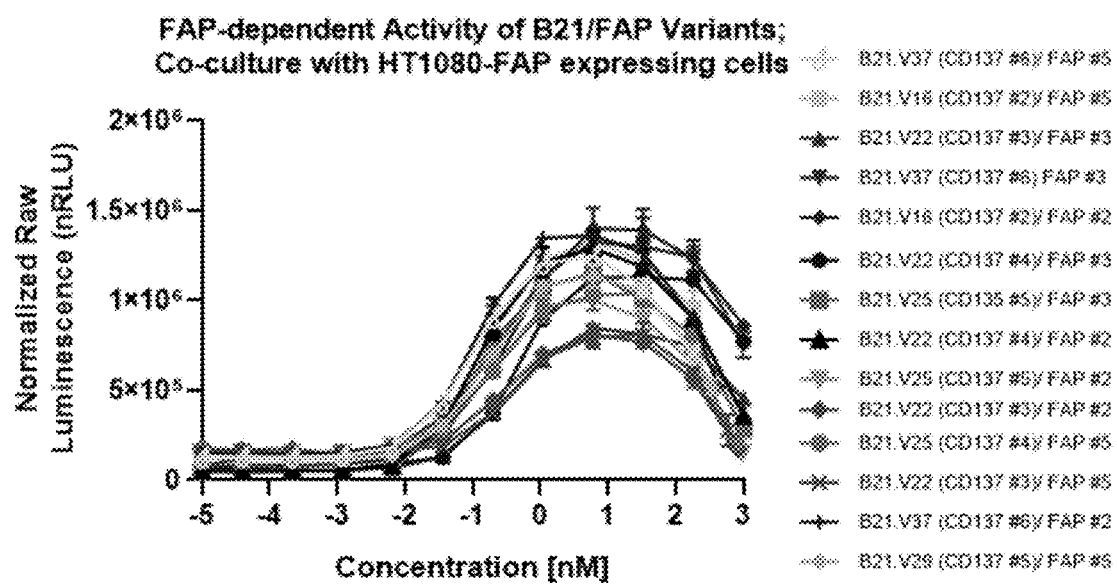
B.
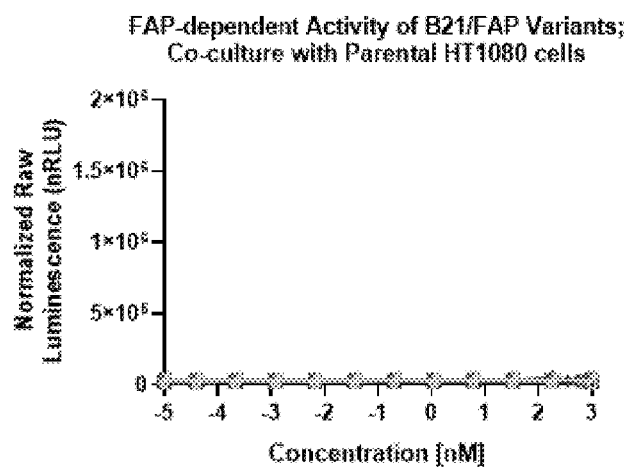

FIG 13A-D, cont.
C.
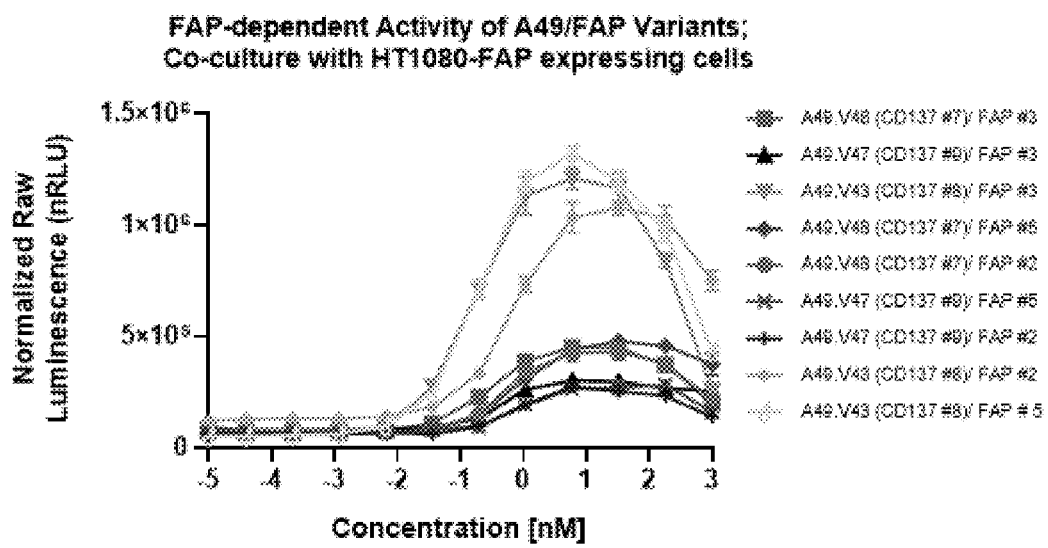
D.
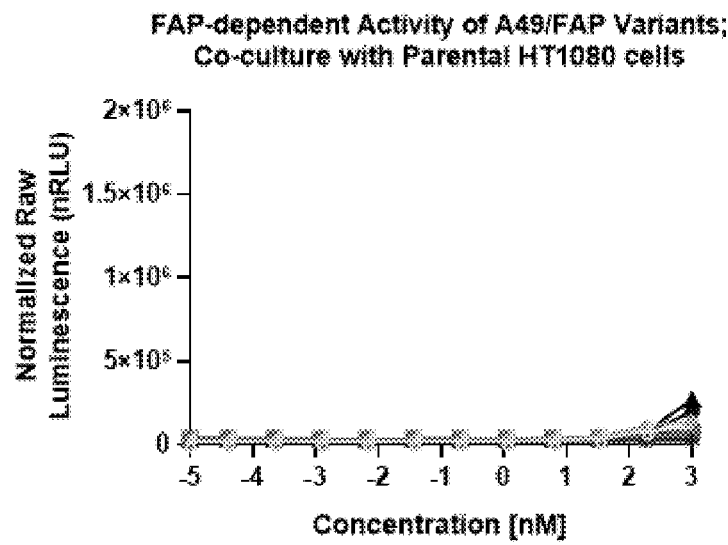

FIG 14A-H
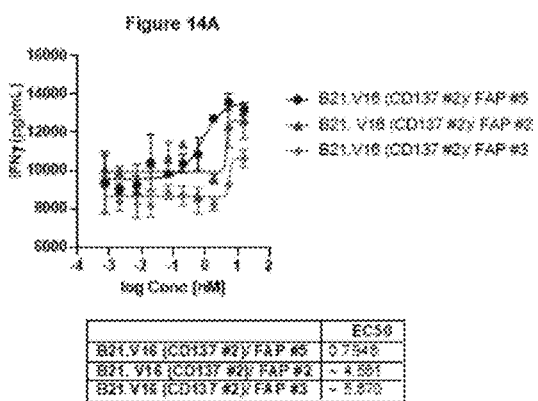
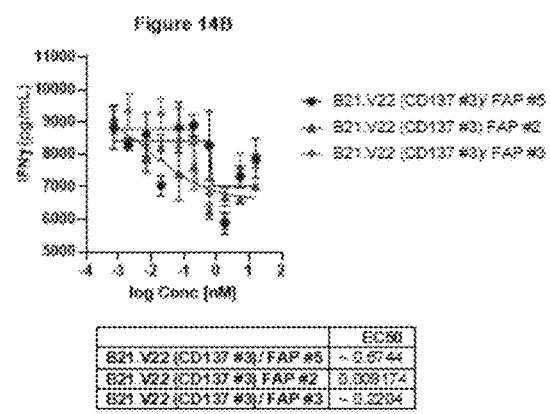
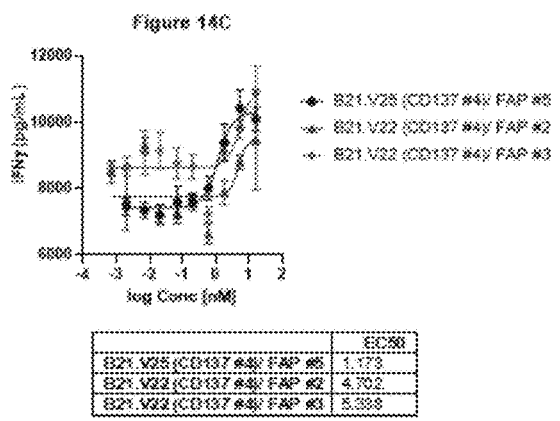
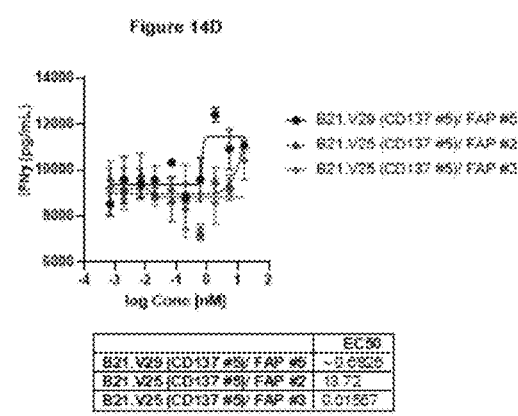

FIG 14A-H, cont.
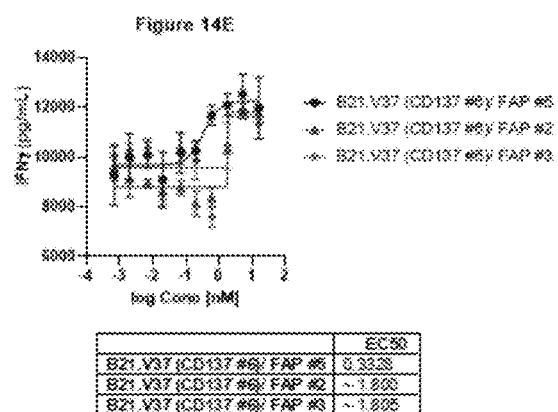
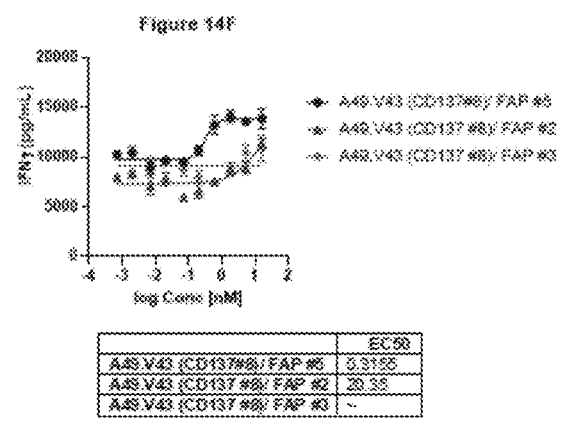
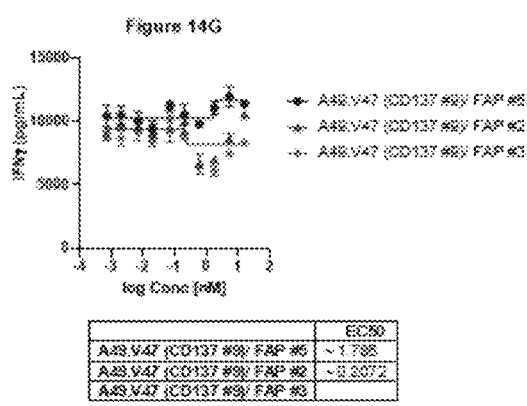
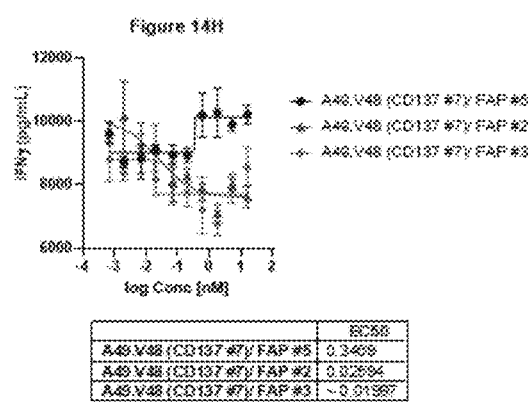

FIG 15A-B
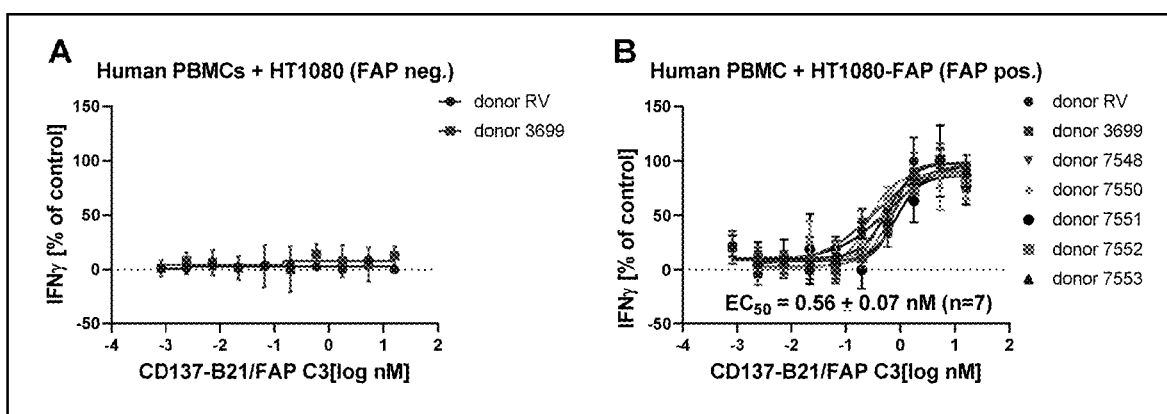

FIG 16A-B
A.
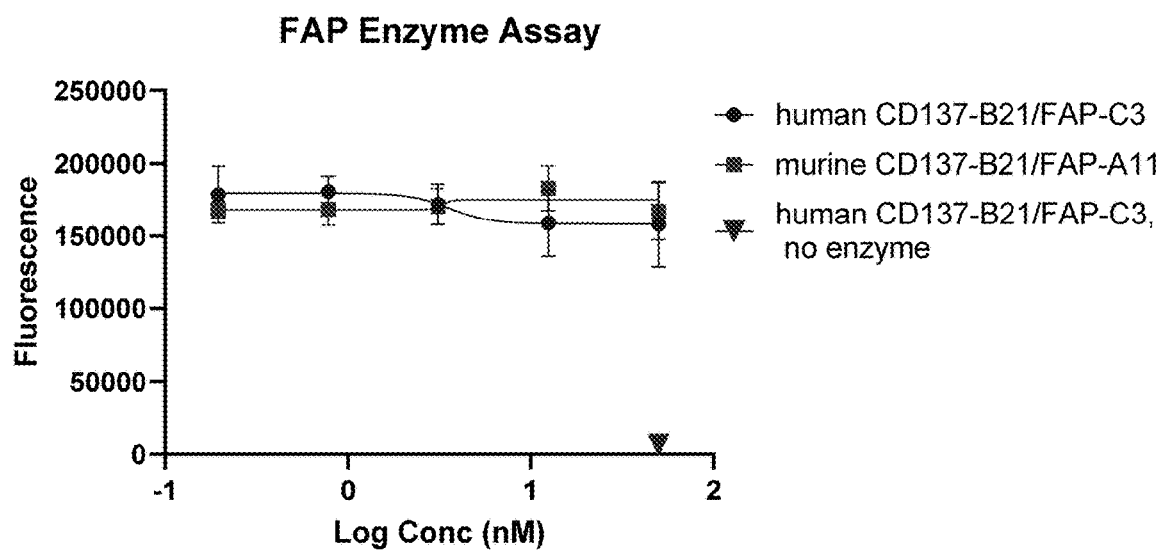
B.
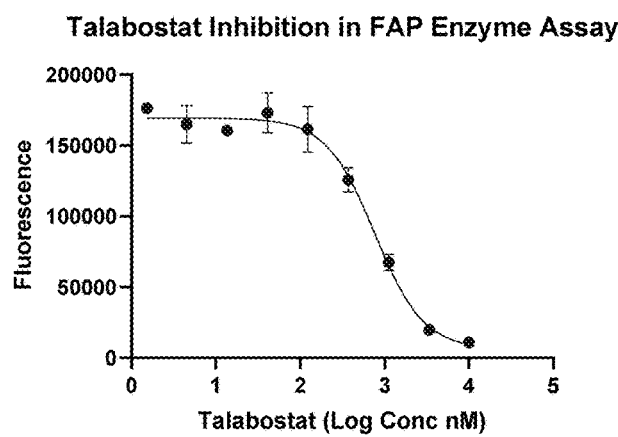

FIG 18A-D
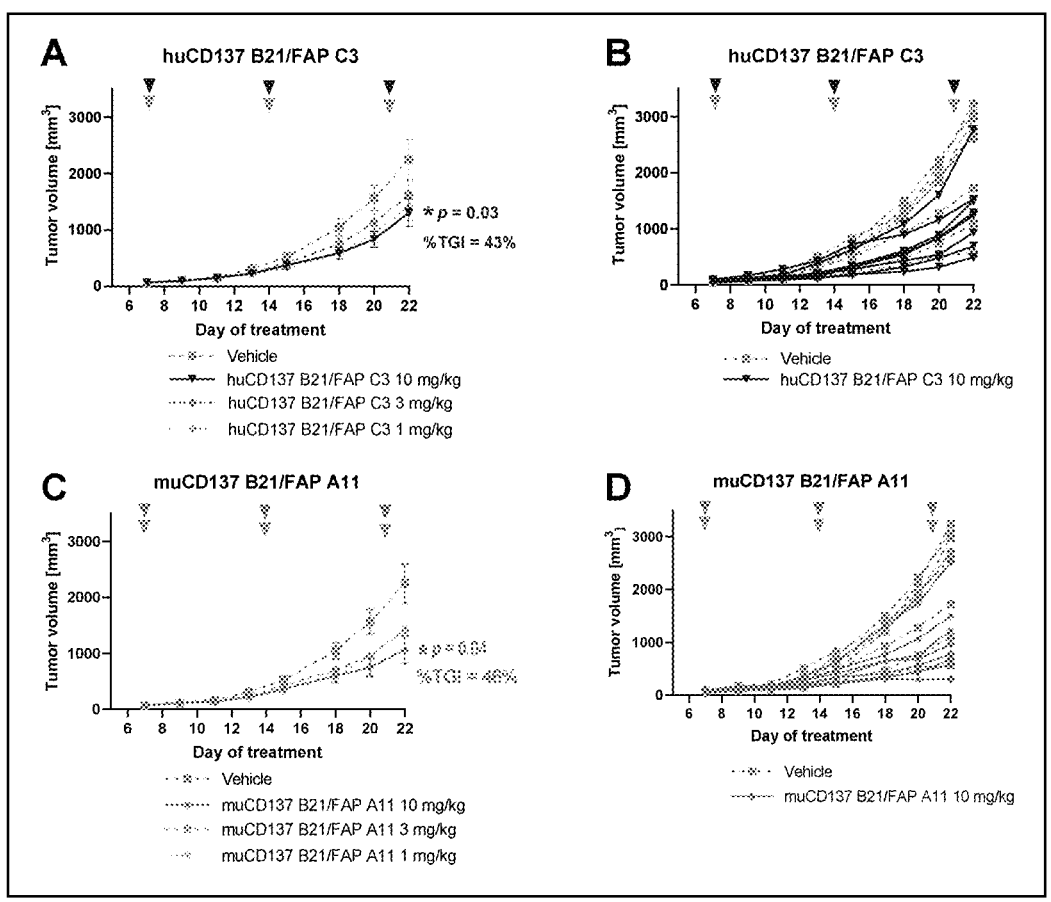

FIG 19A-B
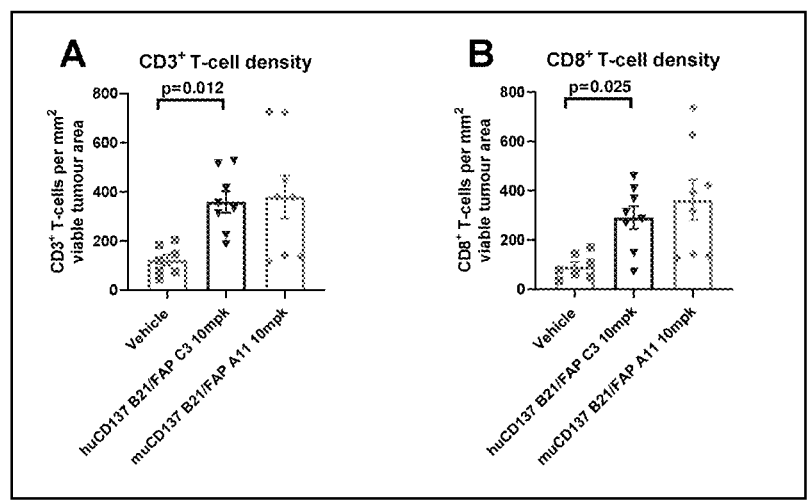

FIG 20A-E
A.
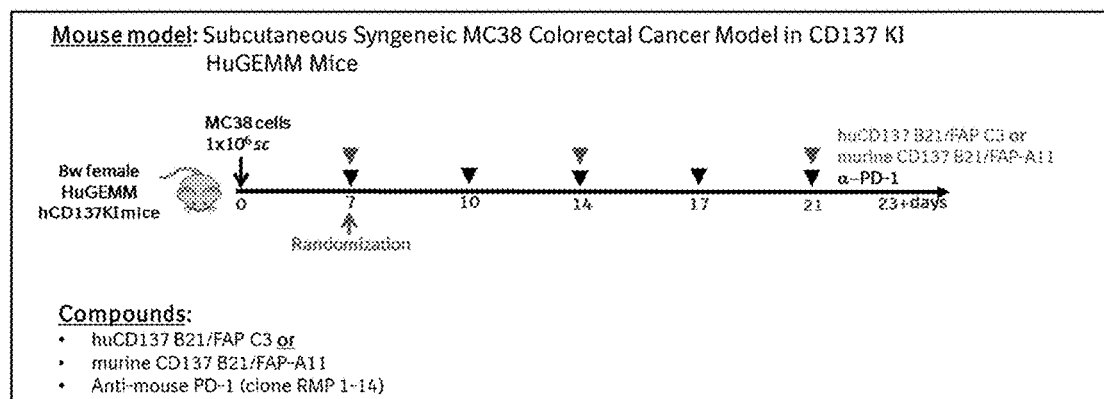
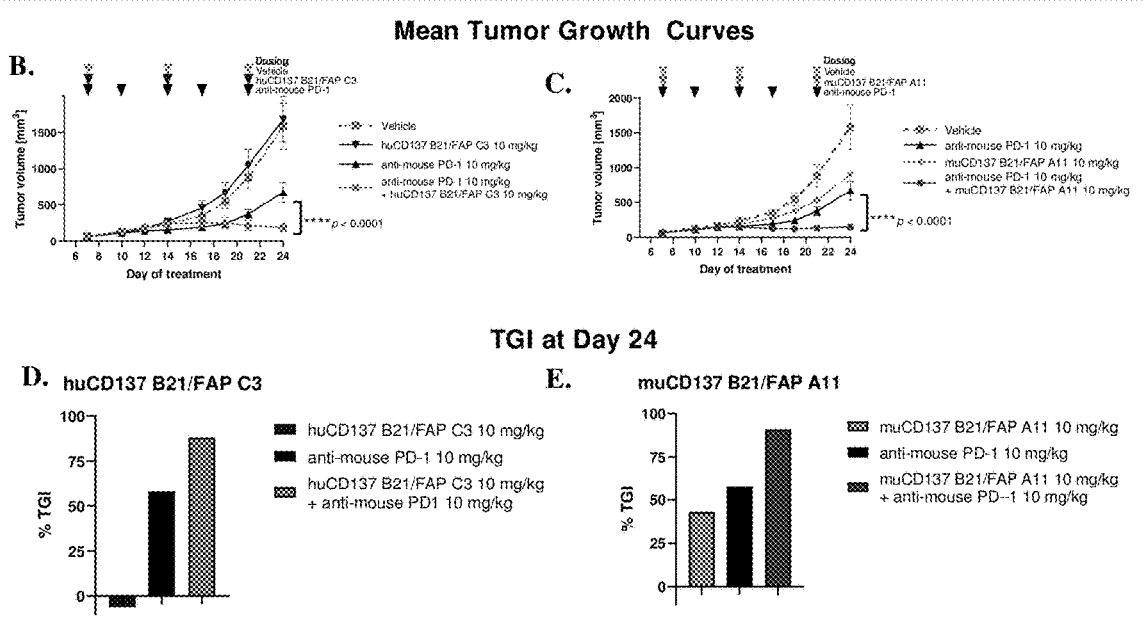

FIG 21A- G
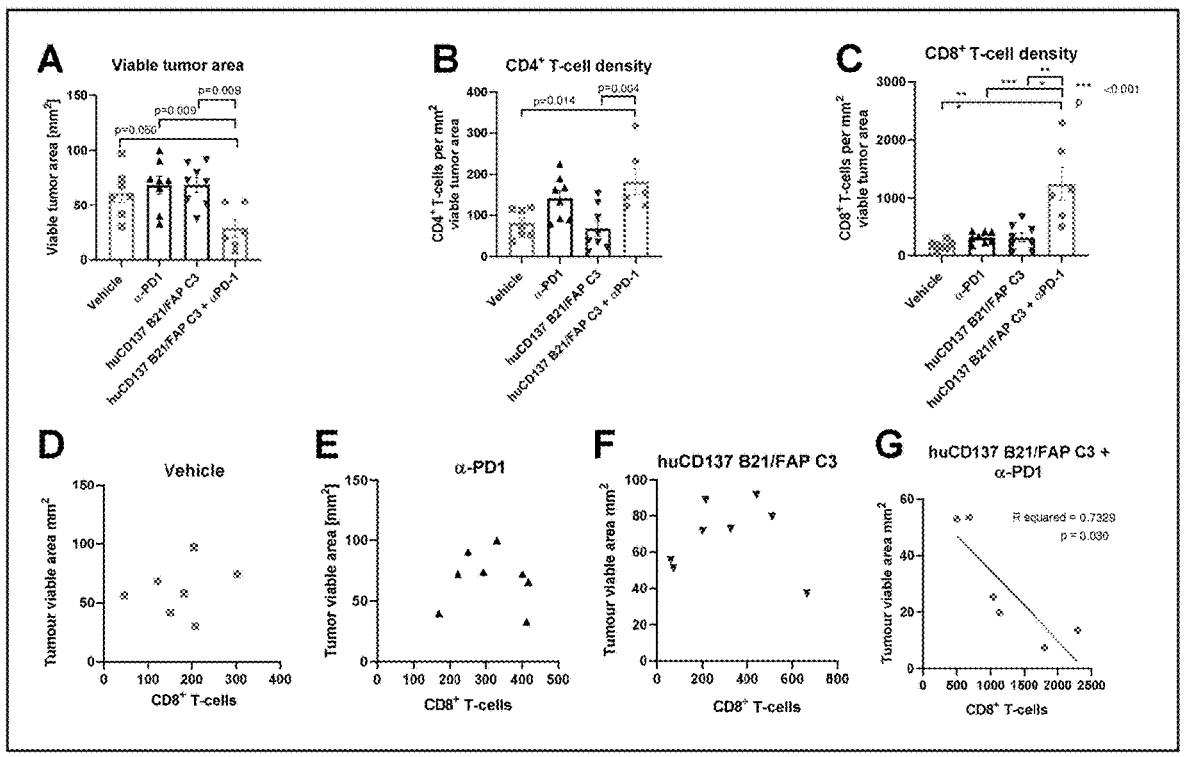

FIG 22

|  | K-CDR1 | | | | | K-CDR2 | | | | |
|---|---|---|---|---|---|---|---|---|---|---|
| Linear AA No. | 24 | 28 | 29 | 31 | 33 | 50 | 53 | 54 | 55 | 56 |
| Chi Ig VK | K | D | V | T | V | S | Y | R | Y | T |
| Germline | R | S | I | S | L | A | S | L | Q | S |
| K24R | R | D | V | T | V | S | Y | R | Y | T |
| D28S | K | S | V | T | V | S | Y | R | Y | T |
| V29I | K | D | I | T | V | S | Y | R | Y | T |
| T31S | K | D | V | S | V | S | Y | R | Y | T |
| V33L | K | D | V | T | L | S | Y | R | Y | T |
| S50A | K | D | V | T | V | A | Y | R | Y | T |
| Y53S | K | D | V | T | V | S | S | R | Y | T |
| R54L | K | D | V | T | V | S | Y | L | Y | T |
| Y55Q | K | D | V | T | V | S | Y | R | Q | T |
| T56S | K | D | V | T | V | S | Y | R | Y | S |

FIG 23

| CD137#1 CLONE | Vk VARIANT CDRS | | | VH PARENTAL CDRS | | |
|---|---|---|---|---|---|---|
| | CDR1 | CDR2 | CDR3 | CDR1 | CDR2 | CDR3 |
| PARENT | KASQDVSTAVA SEQ ID NO.:12 | SASYRYT SEQ ID NO.:13 | QQHYSNPWT SEQ ID NO.:14 | GFTFSDFYMA SEQ ID NO: 7 | NINYDGSSTYYLDSLKS SEQ ID NO: 8 | EGDEGWYFDV SEQ ID NO: 9 |
| V55.A | RASQDVSTAVA SEQ ID NO.:497 | SASYRYT SEQ ID NO: 13 | QQHYSNPWT SEQ ID NO: 14 | GFTFSDFYMA SEQ ID NO: 7 | NINYDGSSTYYLDSLKS SEQ ID NO: 8 | EGDEGWYFDV SEQ ID NO: 9 |
| V55.B | KASQSVSTAVA SEQ ID NO.:498 | SASYRYT SEQ ID NO: 13 | QQHYSNPWT SEQ ID NO: 14 | GFTFSDFYMA SEQ ID NO: 7 | NINYDGSSTYYLDSLKS SEQ ID NO: 8 | EGDEGWYFDV SEQ ID NO: 9 |
| V55.C | KASQDIVSTAVA SEQ ID NO.:499 | SASYRYT SEQ ID NO: 13 | QQHYSNPWT SEQ ID NO: 14 | GFTFSDFYMA SEQ ID NO: 7 | NINYDGSSTYYLDSLKS SEQ ID NO: 8 | EGDEGWYFDV SEQ ID NO: 9 |
| V55.D | KASQDVSSAVA SEQ ID NO.:500 | SASYRYT SEQ ID NO: 13 | QQHYSNPWT SEQ ID NO: 14 | GFTFSDFYMA SEQ ID NO: 7 | NINYDGSSTYYLDSLKS SEQ ID NO: 8 | EGDEGWYFDV SEQ ID NO: 9 |
| V55.E | KASQDVSTALA SEQ ID NO.:501 | SASYRYT SEQ ID NO: 13 | QQHYSNPWT SEQ ID NO: 14 | GFTFSDFYMA SEQ ID NO: 7 | NINYDGSSTYYLDSLKS SEQ ID NO: 8 | EGDEGWYFDV SEQ ID NO: 9 |
| V55 F | KASQDVSTAVA SEQ ID NO: 12 | AASYRYT SEQ ID NO.:502 | QQHYSNPWT SEQ ID NO: 14 | GFTFSDFYMA SEQ ID NO: 7 | NINYDGSSTYYLDSLKS SEQ ID NO: 8 | EGDEGWYFDV SEQ ID NO: 9 |
| V55.G | KASQDVSTAVA SEQ ID NO: 12 | SASSRYT SEQ ID NO.:503 | QQHYSNPWT SEQ ID NO: 14 | GFTFSDFYMA SEQ ID NO: 7 | NINYDGSSTYYLDSLKS SEQ ID NO: 8 | EGDEGWYFDV SEQ ID NO: 9 |
| V55.H | KASQDVSTAVA SEQ ID NO: 12 | SASYLYT SEQ ID NO.:504 | QQHYSNPWT SEQ ID NO: 14 | GFTFSDFYMA SEQ ID NO: 7 | NINYDGSSTYYLDSLKS SEQ ID NO: 8 | EGDEGWYFDV SEQ ID NO: 9 |
| V55.I | KASQDVSTAVA SEQ ID NO: 12 | SASYRQT SEQ ID NO.:505 | QQHYSNPWT SEQ ID NO: 14 | GFTFSDFYMA SEQ ID NO: 7 | NINYDGSSTYYLDSLKS SEQ ID NO: 8 | EGDEGWYFDV SEQ ID NO: 9 |
| V55.J | KASQDVSTAVA SEQ ID NO: 12 | SASYRYS SEQ ID NO.:506 | QQHYSNPWT SEQ ID NO: 14 | GFTFSDFYMA SEQ ID NO: 7 | NINYDGSSTYYLDSLKS SEQ ID NO: 8 | EGDEGWYFDV SEQ ID NO: 9 |

FIG 24

|  | H-CDR1 | | | | H-CDR2 | | | | | | | | | | | | | | |
|---|---|---|---|---|---|---|---|---|---|---|---|---|---|---|---|---|---|---|---|
| Linear AA No. | 31 | 32 | 33 | 35 | 52 | 53 | 54 | 55 | 55 | 55 | 57 | 58 | 61 | 62 | 63 | 63 | 63 | 64 | 66 |
| Chi Ig VH | D | F | Y | A | N | Y | D | G | G | G | S | T | L | D | S | S | S | L | S |
| Germline | S | Y | W | S | K | Q | E | I | L | V | E | K | V | E | I | L | V | V | G |
| D31S | S | F | Y | A | N | Y | D | G | G | G | S | T | L | D | S | S | S | L | S |
| F32Y | D | Y | Y | A | N | Y | D | G | G | G | S | T | L | D | S | S | S | L | S |
| Y33W | D | F | W | A | N | Y | D | G | G | G | S | T | L | D | S | S | S | L | S |
| A35S | D | F | Y | S | N | Y | D | G | G | G | S | T | L | D | S | S | S | L | S |
| N52K | D | F | Y | A | K | Y | D | G | G | G | S | T | L | D | S | S | S | L | S |
| Y53Q | D | F | Y | A | N | Q | D | G | G | G | S | T | L | D | S | S | S | L | S |
| D54E | D | F | Y | A | N | Y | E | G | G | G | S | T | L | D | S | S | S | L | S |
| G55I | D | F | Y | A | N | Y | D | I | G | G | S | T | L | D | S | S | S | L | S |
| G55L | D | F | Y | A | N | Y | D | G | L | G | S | T | L | D | S | S | S | L | S |
| G55V | D | F | Y | A | N | Y | D | G | G | V | S | T | L | D | S | S | S | L | S |
| S57E | D | F | Y | A | N | Y | D | G | G | G | E | T | L | D | S | S | S | L | S |
| T58K | D | F | Y | A | N | Y | D | G | G | G | S | K | L | D | S | S | S | L | S |
| L61V | D | F | Y | A | N | Y | D | G | G | G | S | T | V | D | S | S | S | L | S |
| D62E | D | F | Y | A | N | Y | D | G | G | G | S | T | L | E | S | S | S | L | S |
| S63I | D | F | Y | A | N | Y | D | G | G | G | S | T | L | D | I | S | S | L | S |
| S63L | D | F | Y | A | N | Y | D | G | G | G | S | T | L | D | S | L | S | L | S |
| S63V | D | F | Y | A | N | Y | D | G | G | G | S | T | L | D | S | S | V | L | S |
| L64V | D | F | Y | A | N | Y | D | G | G | G | S | T | L | D | S | S | S | V | S |
| S66G | D | F | Y | A | N | Y | D | G | G | G | S | T | L | D | S | S | S | L | G |

FIG 25

| CD137 #1 Clone | Vk PARENTAL | | | VH VARIANTS | | |
|---|---|---|---|---|---|---|
| | CDR1 | CDR2 | CDR3 | CDR1 | CDR2 | CDR3 |
| PARENT | KASQDVSTAVA | SASYRYT | QQHYSNPWT | GFTFSDFYMA | NIN YDG SST YYL DSL KS | EGDEGWYFDV |
| | SEQ ID NO.:12 | SEQ ID NO.:13 | SEQ ID NO.:14 | SEQ ID NO.:7 | SEQ ID NO.:8 | SEQ ID NO.:9 |
| V55.K | KASQDVSTAVA | SASYRYT | QQHYSNPWT | GFTFSSFYMA | NINYDGSSTYYLDSLKS | EGDEGWYFDV |
| | SEQ ID NO: 12 | SEQ ID NO: 13 | SEQ ID NO: 14 | SEQ ID NO.:507 | SEQ ID NO: 8 | SEQ ID NO: 9 |
| V55.L | KASQDVSTAVA | SASYRYT | QQHYSNPWT | GFTFSDFYYMA | NINYDGSSTYYLDSLKS | EGDEGWYFDV |
| | SEQ ID NO: 12 | SEQ ID NO: 13 | SEQ ID NO: 14 | SEQ ID NO.:508 | SEQ ID NO: 8 | SEQ ID NO: 9 |
| V55.M | KASQDVSTAVA | SASYRYT | QQHYSNPWT | GFTFSDFWMA | NINYDGSSTYYLDSLKS | EGDEGWYFDV |
| | SEQ ID NO: 12 | SEQ ID NO: 13 | SEQ ID NO: 14 | SEQ ID NO.:509 | SEQ ID NO: 8 | SEQ ID NO: 9 |
| V55.N | KASQDVSTAVA | SASYRYT | QQHYSNPWT | GFTFSDFYMS | NINYDGSSTYYLDSLKS | EGDEGWYFDV |
| | SEQ ID NO: 12 | SEQ ID NO: 13 | SEQ ID NO: 14 | SEQ ID NO.:510 | SEQ ID NO: 8 | SEQ ID NO: 9 |
| V55.O | KASQDVSTAVA | SASYRYT | QQHYSNPWT | GFTFSDFYMA | NIKYDGSSTYYLDSLKS | EGDEGWYFDV |
| | SEQ ID NO: 12 | SEQ ID NO: 13 | SEQ ID NO: 14 | SEQ ID NO: 7 | SEQ ID NO.:511 | SEQ ID NO: 9 |
| V55.P | KASQDVSTAVA | SASYRYT | QQHYSNPWT | GFTFSDFYMA | NINQDGSSTYYLDSLKS | EGDEGWYFDV |
| | SEQ ID NO: 12 | SEQ ID NO: 13 | SEQ ID NO: 14 | SEQ ID NO: 7 | SEQ ID NO.:512 | SEQ ID NO: 9 |
| V55.Q | KASQDVSTAVA | SASYRYT | QQHYSNPWT | GFTFSDFYMA | NINYEGSSTYYLDSLKS | EGDEGWYFDV |
| | SEQ ID NO: 12 | SEQ ID NO: 13 | SEQ ID NO: 14 | SEQ ID NO: 7 | SEQ ID NO.:513 | SEQ ID NO: 9 |
| V55.R | KASQDVSTAVA | SASYRYT | QQHYSNPWT | GFTFSDFYMA | NINYDISSTYYLDSLKS | EGDEGWYFDV |
| | SEQ ID NO: 12 | SEQ ID NO: 13 | SEQ ID NO: 14 | SEQ ID NO: 7 | SEQ ID NO.:514 | SEQ ID NO: 9 |
| V55.S | KASQDVSTAVA | SASYRYT | QQHYSNPWT | GFTFSDFYMA | NINYDLSSTYYLDSLKS | EGDEGWYFDV |
| | SEQ ID NO: 12 | SEQ ID NO: 13 | SEQ ID NO: 14 | SEQ ID NO: 7 | SEQ ID NO.:515 | SEQ ID NO: 9 |
| V55.T | KASQDVSTAVA | SASYRYT | QQHYSNPWT | GFTFSDFYMA | NINYDVSSTYYLDSLKS | EGDEGWYFDV |
| | SEQ ID NO: 12 | SEQ ID NO: 13 | SEQ ID NO: 14 | SEQ ID NO: 7 | SEQ ID NO.:516 | SEQ ID NO: 9 |
| V55.U | KASQDVSTAVA | SASYRYT | QQHYSNPWT | GFTFSDFYMA | NINYDSSKYYLDSLKS | EGDEGWYFDV |
| | SEQ ID NO: 12 | SEQ ID NO: 13 | SEQ ID NO: 14 | SEQ ID NO: 7 | SEQ ID NO.:517 | SEQ ID NO: 9 |
| V55.V | KASQDVSTAVA | SASYRYT | QQHYSNPWT | GFTFSDFYMA | NINYDGSSTYYVDSLKS | EGDEGWYFDV |
| | SEQ ID NO: 12 | SEQ ID NO: 13 | SEQ ID NO: 14 | SEQ ID NO: 7 | SEQ ID NO.:518 | SEQ ID NO: 9 |
| V55.W | KASQDVSTAVA | SASYRYT | QQHYSNPWT | GFTFSDFYMA | NINYDGSSKYYLESLKS | EGDEGWYFDV |
| | SEQ ID NO: 12 | SEQ ID NO: 13 | SEQ ID NO: 14 | SEQ ID NO: 7 | SEQ ID NO.:519 | SEQ ID NO: 9 |
| V55.X | KASQDVSTAVA | SASYRYT | QQHYSNPWT | GFTFSDFYMA | NINYDGSSTYYLDILKS | EGDEGWYFDV |
| | SEQ ID NO: 12 | SEQ ID NO: 13 | SEQ ID NO: 14 | SEQ ID NO: 7 | SEQ ID NO.:520 | SEQ ID NO: 9 |
| V55.Y | KASQDVSTAVA | SASYRYT | QQHYSNPWT | GFTFSDFYMA | NINYDGSSTYYLDLLKS | EGDEGWYFDV |
| | SEQ ID NO: 12 | SEQ ID NO: 13 | SEQ ID NO: 14 | SEQ ID NO: 7 | SEQ ID NO.:521 | SEQ ID NO: 9 |
| V55.Z | KASQDVSTAVA | SASYRYT | QQHYSNPWT | GFTFSDFYMA | NINYDGSSTYYLDVLKS | EGDEGWYFDV |
| | SEQ ID NO: 12 | SEQ ID NO: 13 | SEQ ID NO: 14 | SEQ ID NO: 7 | SEQ ID NO.:522 | SEQ ID NO: 9 |
| V55.AA | KASQDVSTAVA | SASYRYT | QQHYSNPWT | GFTFSDFYMA | NINYDGSSTYYLDSVKS | EGDEGWYFDV |
| | SEQ ID NO: 12 | SEQ ID NO: 13 | SEQ ID NO: 14 | SEQ ID NO: 7 | SEQ ID NO.:523 | SEQ ID NO: 9 |
| V55.BB | KASQDVSTAVA | SASYRYT | QQHYSNPWT | GFTFSDFYMA | NINYDGSSTYYLDSLKG | EGDEGWYFDV |
| | SEQ ID NO: 12 | SEQ ID NO: 13 | SEQ ID NO: 14 | SEQ ID NO: 7 | SEQ ID NO.:524 | SEQ ID NO: 9 |

BISPECIFIC AND TETRAVALENT CD137 AND FAP MOLECULES FOR THE TREATMENT OF CANCER

SEQUENCE LISTING

The instant application contains a Sequence Listing which has been submitted electronically in ASCII format and is hereby incorporated by reference in its entirety. Said ASCII copy, created on Apr. 22, 2021, is named 09-0703-US-3_SL.txt and is 873,263 bytes in size.

FIELD OF THE INVENTION

This invention relates to binding molecules that bind to CD137 (4-1BB, TNFRSF9), a member of the TNFR family and Fibroblast activation protein (FAP) and their use in medicine, pharmaceutical compositions containing the same, and methods of using the same as agents for treatment and/or prevention of cancer.

BACKGROUND OF THE INVENTION

Cancer is a group of diseases commonly based on abnormal cell proliferation and the potential for cancerous cells to invade or spread throughout the body. It is a serious disease and a major cause of death globally.

Various methods of treatment have been used in an attempt to manage or in some cases treat cancer, including surgery, chemotherapy, radiation therapy and hormonal therapy. Recent advances in immunotherapy has changed the treatment landscape for cancer. Still, most patients with locally advanced or metastatic tumors will succumb to their disease, justifying the substantial need for novel therapeutic strategies.

Antibody-based biological molecules offer the potential to be powerful therapeutic agents for the treatment of cancer. Antibodies are designed to recognize and bind to specific proteins on the surface of cells (their target antigens), and such proteins may be present only on the surface of specific cancer cells or on immune cells. This binding can provoke a number of different biological responses, depending on the function of their target antigen protein and also the structure of the antibody itself.

For example, some antibodies trigger the immune system to attack and kill cancer cells, either by attracting immune cells to the cancer cells or by directly influencing the activity of the immune system itself. A further type of antibody-based therapy binds to cancer cells to stop or reduce cell division thus slowing or preventing abnormal cell proliferation. Other types of antibodies have drugs or radioactive particles attached to them and hence deliver these therapeutics to the cancer cell itself.

FAP is a member of the dipeptidyl peptidase (DPP) family (also referred to as fibroblast activation protein alpha, prolyl endopeptidase FAP, 170 kDa melanoma membrane-bound gelatinase, integral membrane serine protease). It is transiently expressed in some fetal mesenchymal tissues, and rarely in healthy adult tissues where FAP presence is normally restricted to endometrial cells. FAP is also expressed during diseases associated with activated stroma, including wound healing, rheumatoid arthritis, osteoarthritis, cirrhosis and pulmonary fibrosis; often induced in activated fibroblasts after trauma or injury to the tissue. FAP is also expressed in tumour stroma tissue of all kinds of human epithelial tumours and in malignant cells of various bone and soft tissue sarcomas. FAP is expressed in more than 90% of human epithelial malignancies, including colorectal, ovarian, breast, bladder and lung. FAP is preferably found in fibroblasts that occur close to newly forming or formed blood vessels and form a specific cellular compartment between the tumour capillary endothelium and the actual malignant epithelial cells and clusters of cells.

Stromal fibroblasts play an important role in the development, growth and metastasis of carcinomas. The expression profile of FAP suggests that FAP plays a part in tumour invasion into healthy tissue and in tumour formation and metastasis. FAP inhibitors, i.e. substances that are capable of reducing or inhibiting the proteolytic activity of FAP, are useful therapeutic agents for the treatment of all kinds of tumour diseases. FAP inhibitors can preferably be used to treat tumours of epithelial origin such as breast tumours, non-small-cell lung carcinomas, colorectal carcinomas and soft tissue carcinomas.

FAP antibodies are known in the art. For example, Sibrotuzumab, is a humanized murine FAP, which after humanization bound to human FAP, but demonstrated no detectable binding to murine FAP and no tumor killing in murine models. (WO1993005804, Cheng, et al. Tumors and their microenvironments: tilling the soil. Commentary re: A. M. Scott et al., A Phase I dose-escalation study of sibrotuzumab in patients with advanced or metastatic fibroblast activation protein-positive cancer. Clin. Cancer Res., 9: 1639-1647). At least 15 different antibodies are in commercial pre-clinical or clinical development that target FAP (See e.g. U.S. Pat. No. 8,999,342 Ludwig Institute for Cancer Research (mAb/preclinical); WO2016110598, US20170369592 Mabimmune Diagnostics/Univ Zurich (mAb/preclinical); WO2015118030, U.S. Ser. No. 10/137,202, Oncomatryx (mAb-conjugate/preclinical); WO1993005804, WO1999057151, WO2001068708, WO2002083171, WO2007077173, U.S. Pat. No. 8,568,727 Sibrotuzumab, Boehringer Ingelheim (humanized murine FAP/terminated after PH1 in colorectal))

CD137 (4-1BB, TNFRSF9, CDw137, T-cell antigen 4-1BB homology, T-cell antigen ILA, CD antigen CD137) is also a member of the tumor necrosis factor receptor superfamily. CD137 is expressed on activated T lymphocytes and upon ligand engagement confers enhanced T-cell function. Activation of CD137 is dependent on receptor oligomerization. CD137 is expressed on activated CD4+ and CD8+ T cells, Treg, DC, monocytes, mast cells and eosinophils. CD137 activation plays an important role in CD8+ T cell activation and survival. It sustains and augments, rather than initiates effector functions and preferentially supports TH1 cytokine production. In CD4+ T cells, CD137 stimulation initially results in activation and later in activation-induced cell death, which suggests mechanistically why CD137 agonistic antibodies can have a therapeutic effect in tumor immunity as well as in autoimmunity.

Further, CD137 is expressed on antigen presenting cells, such as dendritic cells and macrophages, and stimulation of CD137 on these cell types may induce immune activation that can result in tumor directed immunity. CD137 plays an essential role in immune surveillance. Deficiency of CD137 leads to diminished T-cell immune responses in knock out mice, such as cytokine production and cytotolytic T-cell activity (Kwon, 2002, Narazaki, 2010). In humans, CD137 deficiency is associated with immune dysregulation, impairment of lymphocytic responses and EBV-associated lymphomagenesis (Somekh, 2019).

CD137 agonistic antibody has also been shown to activate endothelial cells in the tumor environment, leading to upregulation of ICAM-1 and VCAM-1 and improved T cell recruitment. Several studies have demonstrated induction of tumor immunity by treatment with agonistic CD137 antibodies, with pioneering work dating back to 1997 (Melero, 1997).

More than 25 agents targeting CD137 are currently in pre-clinical or clinical development, but progress for this target has been slow. Urelumab (BMS-66513), a fully human IgG4 antibody developed by Bristol-Myers Squibb, was the first CD137 agonist to enter the clinic in 2005. It showed promising efficacy in melanoma patients in combination with pembrolizumab, but several trials were halted due to liver toxicity concerns. The future of Urelumab is unclear, it has been dropped from BMS pipeline, although a number of BMS-sponsored trials remain ongoing. The other leading CD137 agonist, Pfizer's Utomilumab (PF-05082566), a fully human IgG2 antibody, has demonstrated only modest clinical efficacy in various combinations. While Urelumab can stimulate T-cells in the absence of additional cross-linking, in contrast utomilumab needs FcγR-mediated crosslinking to initiate agonistic effects (Fisher, 2012). In the latter case, FcγR-mediated crosslinking is not a predictable process, which has limited the antitumor efficacy of utomilumab. In April 2018, Pfizer announced it was no longer developing utomilumab as a monotherapy or in combination with pembrolizumab, although other combination trails may be ongoing. Therefore, while preliminary data suggested that utomilumab was tolerated, in contrast to urelumab, it demonstrated only modest tumor effects even in combination with avelumab and rituximab. Pfizer's Phase III study was recently curtailed from 500 to 29 patients.

Newer CD137 agents being developed focus activity at the tumor by simultaneously targeting a tumor antigen (e.g. HER2) and this may allow for increased activity without increased toxicity. CD137/Her2 bispecific PRS-343 has recently shown promising results in a Phase I trial in heavily pre-treated cancer patients across multiple tumor types. PRS-343 demonstrated tumor activity, an increase of tumor-infiltrating CD8+ T-cells and a good safety profile. It is believed that FAP expression on tumor associated fibroblasts in the stroma is more stable than the expression of HER2 on cancer cells and therefore the combination of CD137 with HER2 as co-localized targets, may have limited effectiveness.

Another bispecific CD137/FAP DARPin molecule (MP-0310, from AMGEN/Molecular Partners) is another such tumor targeting molecule, formatted as a monovalent FAP and monovalent CD137 binder. It is not clear whether this format allows the binding of the natural CD137 ligand in vivo, or whether the monovalent CD137 engager is capable of cross-linking CD137, thus sufficiently activating T cells. DARPins (designed ankyrin repeat proteins) are not antibodies, but genetically engineered antibody mimetic proteins; a new class of non-immunoglobulin proteins that have been utilized instead of antibodies to target binding in drug discovery and drug development (See e.g. WO 2002/020565), US20130244940, and Link et al. "Preclinical pharmacology of MP0310: a 4-1BB/FAP bi-specific DARPin® drug candidate promoting tumor restricted T cell co-stimulation." Poster 3572, (https://investors.molecularpartners-.com/~/media/Files/M/Molecular-Partners/documents/201804-mp0310-pharmacology-poster-3752.pdf).

Additionally, a CD137-L/FAP molecule (RG-7827 from Roche targeting) is a trimerized human CD137 ligand not an antibody arm binding. It is unknown whether the CD137 ligand allows for higher order multimerisation of CD137 thought to be necessary for increased agonist activity. Moreover, RG-7827 is expected to compete with the endogenous CD137 ligand. (See e.g., WO2019175125; WO2017055398; WO2017060144; US20170114141; US20170247467; and J. Sam, C. Claus, C. Ferrara, S. Lang, V. Nicolini, S. Colombetti, V. Teichgraber, S. Evers, M. Bacac, P. Umana, C. Klein. (AACR 2018, Poster 5621, FAP-4-1BBL: A novel versatile tumor-stroma targeted 4-1BB agonist for combination immunotherapy with checkpoint inhibitors, T-cell bispecific antibodies, and ADCC-mediating antibodies.)

Thus, while systemic administration of agonistic 4-1BB antibodies may have been shown to be efficacious tumor targeting agents in pre-clinical models, clinical development has not successfully advanced past phase II trials having been hampered by either significant dose-limiting hepatotoxicity, or limited clinical efficacy that may be attributable to relatively low potency and/or dependency on Fcγ receptor-mediated hyperclustering. Therefore, while bispecific CD137 molecules and CD137 molecules with various combination partners are currently in development, safety and clinical efficacy has yet to be demonstrated for this antigen.

In terms of cancer treatment generally, despite the recent major advances, some difficult to treat solid tumors do not respond to available therapies; either drugs that are the current standard of care, or those newer and initially promising drugs that are currently in clinical testing. Even if patients do respond initially, they often do not experience a long lasting response and seldom result in a full remission or cure. For example, in the case of non-small cell lung cancer, one such unmet need, some 40-50% of all NSCLC do not respond to first line therapy, while another 50% who do respond, do not experience a long lasting response with current 1st line therapies (e.g., including anti-PD1 immunotherapy). Moreover, less than 30-40% of patients remain progression-free after 12 months. Options for further therapy for patients in 2nd/3rd line who have previously received anti-PD-L1 treatment are limited and not fully established. Since chemotherapy options such as docetaxel or platinum based regimen (if not used in 1st line) are of limited benefit.

In view of the available pre-clinical and clinical data, and of the poor outlook for such cancer patients, there is a clear need to identify more efficacious therapies, particularly those therapies with improved tolerability for the patient and targeted specificity for tumor types resistant to presently available therapies. As such, there is a need for new approaches including immunologically active agents with different modes of actions.

SUMMARY OF THE INVENTION

The present invention is based on the concept that tumor restricted activation of tumor-specific TILs represents a promising modality to the treatment of cancer. Embodiments of the invention are bispecific, bivalent molecules which combine binding sites that binds specifically to Fibroblast activation protein (FAP) with low affinity binding sites that binds specifically to CD137 (4-1BB, TNFRSF9) within a single binding molecule. The bispecific molecules of the invention activate, engage with CD137 on T cells only in the context of the cancer stroma of the tumor microenvironment where FAP is expressed.

As discussed in more detail below, one advantage of the molecule of the invention is the improvement of activation of tumor reactive T cells and expansion of existing tumor response to the tumor microenvironment leading to tumor regression in patients while improving on safety relative to conventional CD137 agonists. By making CD137 engagement conditional on the proximal expression of FAP because of its low affinity, the CD137 activity and recruitment of T cells only occurs in the FAP+ tumor environment of many cancer types. This low affinity engagement is an improvement over other CD137 monovalent approaches because the bivalent molecules of the invention only significantly bind to and activate those tumor residing T-cells in the presence of FAP, causing them to proliferate and secrete IFNγ, thus yielding a better localized tumor-directed immune response. Ultimately, the targeted activity of the CD137/FAP antibody will lead to tumor regression in patients with a well tolerated and improved safety profile relative to conventional CD137 agonists.

Hence, a first aspect of the invention provides an immunoglobulin-like binding molecule having at least one antigen binding site that binds specifically to Fibroblast activation protein (FAP) and at least one antigen binding site that binds specifically to CD137 (4-1BB, TNFRSF9).

In a preferred embodiment of the binding molecule of the invention, the molecule is bispecific and tetravalent; bivalent for CD137 and bivalent for FAP.

In a preferred embodiment of the binding molecule of the invention, the antigen binding site that binds specifically to CD137 (4-1BB, TNFRSF9) is part of an immunoglobulin (Ig) molecule and the antigen binding site that binds specifically to Fibroblast activation protein (FAP) comprises one or more scFv(s) fused to N-terminus of the Fc domain, preferably via a peptide linker.

In a preferred embodiment of the binding molecule of the invention, the one or more scFv(s) have a VL-VH orientation from N-to C-terminus.

In a preferred embodiment of the binding molecule of the invention, the one or more scFv(s) are fused to the C-terminus of the heavy chain of the Ig molecule.

In a preferred embodiment of the binding molecule of the invention, the Ig molecule is IgG1KO.

In a preferred embodiment of the binding molecule of the invention, the one or more scFv(s) is fused to the Ig molecule by a peptide linker, preferably a peptide linker having a length of. about 4 to 20 amino acids In a preferred embodiment of the binding molecule of the invention, the antigen binding molecule that binds specifically to CD137 (4-1BB) is selected from a group comprising:

i) heavy chain CDRs comprising the amino acid sequences of SEQ ID NO.:290 (CDR1), SEQ ID NO.:8 (CDR2) and SEQ ID NO.:9 (CDR3) and light chain CDRs comprising the amino acid sequences of SEQ ID NO.:12 (CDR1), SEQ ID NO.:13 (CDR2) and SEQ ID NO.:14 (CDR3); or ii) heavy chain CDRs comprising the amino acid sequences of SEQ ID NO.:295 (CDR1), SEQ ID NO.: 18 (CDR2) and SEQ ID NO.:9 (CDR3) and light chain CDRs comprising the amino acid sequences of SEQ ID NO.:22 (CDR1), SEQ ID NO.:23 (CDR2) and SEQ ID NO.:14 (CDR3); or iii) heavy chain CDRs comprising the amino acid sequences of SEQ ID NO.:295 (CDR1), SEQ ID NO.: 28 (CDR2) and SEQ ID NO.:9 (CDR3) and light chain CDRs comprising the amino acid sequences of SEQ ID NO.:32 (CDR1), SEQ ID NO.:33 (CDR2) and SEQ ID NO.:14 (CDR3); or iv) heavy chain CDRs comprising the amino acid sequences of SEQ ID NO.:295 (CDR1), SEQ ID NO.: 38 (CDR2) and SEQ ID NO.:9 (CDR3) and light chain CDRs comprising the amino acid sequences of SEQ ID NO.:42 (CDR1), SEQ ID NO.:43 (CDR2) and SEQ ID NO.:14 (CDR3); or v) heavy chain CDRs comprising the amino acid sequences of SEQ ID NO.:295 (CDR1), SEQ ID NO.: 48 (CDR2) and SEQ ID NO.:9 (CDR3) and light chain CDRs comprising the amino acid sequences of SEQ ID NO.:52 (CDR1), SEQ ID NO.:53 (CDR2) and SEQ ID NO.:14 (CDR3); or vi) heavy chain CDRs comprising the amino acid sequences of SEQ ID NO.:295 (CDR1), SEQ ID NO.: 58 (CDR2) and SEQ ID NO.:9 (CDR3) and light chain CDRs comprising the amino acid sequences of SEQ ID NO.:62 (CDR1), SEQ ID NO.:63 (CDR2) and SEQ ID NO.:14 (CDR3); or vii) heavy chain CDRs comprising the amino acid sequences of SEQ ID NO.:308 (CDR1), SEQ ID NO.: 68 (CDR2) and SEQ ID NO.:69 (CDR3) and light chain CDRs comprising the amino acid sequences of SEQ ID NO.:72 (CDR1), SEQ ID NO.:73 (CDR2) and SEQ ID NO.:74 (CDR3); or viii) heavy chain CDRs comprising of SEQ ID NO.:308 (CDR1), SEQ ID NO.:78 (CDR2) and SEQ ID NO.:69 (CDR3) and light chain CDRs comprising the amino acid sequences of SEQ ID NO.:72 (CDR1), SEQ ID NO.:73 (CDR2) and SEQ ID NO.:74 (CDR3); or ix) heavy chain CDRs comprising of SEQ ID NO.:308 (CDR1), SEQ ID NO.:88 (CDR2) and SEQ ID NO.:69 (CDR3) and light chain CDRs comprising the amino acid sequences of SEQ ID NO.:92 (CDR1), SEQ ID NO.:93 (CDR2) and SEQ ID NO.:74 (CDR3); or x) heavy chain CDRs comprising of SEQ ID NO.:308 (CDR1), SEQ ID NO.:98 (CDR2) and SEQ ID NO.:69 (CDR3) and light chain CDRs comprising the amino acid sequences of SEQ ID NO.:93 (CDR1), SEQ ID NO.:93 (CDR2) and SEQ ID NO.:74 (CDR3); or xi) heavy chain CDRs comprising the amino acid sequences of SEQ ID NO.:672 (CDR1) wherein X1 is selected from the group consisting of A or S, SEQ ID NO.:335 (CDR2) wherein X1 is selected from the group consisting of N or Q, X2 is selected from the group consisting of D or E, X3 is selected from the group consisting of G or A, and X4 is selected from the group consisting of T or K, X5 is selected from the group consisting of L or V, X6 is selected from the group consisting of D or E, X7 is selected from the group consisting of L or V, and X8 is selected from the group consisting of S or G, and SEQ ID NO.:9 (CDR3) and light chain CDRs comprising the amino acid sequences of SEQ ID NO.:336 (CDR1) wherein X1 is selected from the group consisting of K or R, X2 is selected from the group consisting of D or S, X3 is selected from the group consisting of V or I, X4 is selected from the group consisting of S or T, and X5 is selected from the group consisting of V and L, SEQ ID NO.:337 (CDR2) wherein X1 is selected from the group consisting of S or A, X2 is selected from the group consisting of Y or S, X3 is selected from the group consisting of R or L, X4 is selected from the group consisting of Y and Q, and X5 is selected from the group consisting of S or T, and SEQ ID NO.:14 (CDR3); or xii) heavy chain CDRs comprising of SEQ ID NO.:308 (CDR1), SEQ ID NO.:338 (CDR2) wherein X1 is selected from the group consisting of Y or I, and SEQ ID NO.:69 (CDR3) and light chain CDRs comprising the amino acid sequences of SEQ ID NO.:669 (CDR1) wherein X1 is selected from the group consisting of N or Q, SEQ ID NO.:339 (CDR2) wherein X1 is selected from the group consisting of L or G, and SEQ ID NO.:74 (CDR3); or xiii) a CD137 antigen binding molecule which binds an epitope on CD137 in the extracellular domain CRD3 between amino acids 87-118 (SEQ ID NO.:352) and blocks binding and/or competes for binding with any of the above antigen binding molecules (i)-(xii); or xvi) a CD137 antigen binding molecule which binds to an epitope on CD137 in the extracellular domain CRD2/CRD3 between amino acids 46-117 (SEQ ID NO.:356) and blocks binding and/or competes for binding with any of the above antigen binding molecules (i)-(xvi).

In a preferred embodiment of the immunoglobulin-like binding molecule of the invention, the antigen binding site that binds specifically to CD137 (4-1BB) is part of an immunoglobulin molecule comprising a variable heavy chain region and variable light chain region, wherein the VH and VL regions are selected from a group comprising:

i) a variable heavy chain comprising the amino acid sequence of SEQ ID NO.:10 and a variable light chain comprising the amino acid sequence of SEQ ID NO.:15; or ii) a variable heavy chain comprising the amino acid sequence of SEQ ID NO.:20 and a variable light chain comprising the amino acid sequence of SEQ ID NO.:25; or iii) a variable heavy chain comprising the amino acid sequence of SEQ ID NO.:30 and a variable light chain comprising the amino acid sequence of SEQ ID NO.:35; or iv) a variable heavy chain comprising the amino acid sequence of SEQ ID NO.:40 and a variable light chain comprising the amino acid sequence of SEQ ID NO.:45; or v) a variable heavy chain comprising the amino acid sequence of SEQ ID NO.:50 and a variable light chain comprising the amino acid sequence of SEQ ID NO.:55; or vi) a variable heavy chain comprising the amino acid sequence of SEQ ID NO.:60 and a variable light chain comprising the amino acid sequence of SEQ ID NO.:65; or vii) a variable heavy chain comprising the amino acid sequence of SEQ ID NO.:70 and a variable light chain comprising the amino acid sequence of SEQ ID NO.:75; or viii) a variable heavy chain comprising the amino acid sequence of SEQ ID NO.:80 and a variable light chain comprising the amino acid sequence of SEQ ID NO.:85; or ix) a variable heavy chain comprising the amino acid sequence of SEQ ID NO.:90 and a variable light chain comprising the amino acid sequence of SEQ ID NO.:95; or x) a variable heavy chain comprising the amino acid sequence of SEQ ID NO.:100 and a variable light chain comprising the amino acid sequence of SEQ ID NO.:105; or (xi) a variable heavy chain comprising the amino acid sequence of SEQ ID NO.:10 which differs in amino acid sequence from the CDRH1 SEQ ID NO.:672 by an amino acid substitution of not more than one amino acids wherein X1 is selected from the group consisting of A or S, and/or differs in amino acid sequence from the CDRH2 SEQ ID NO.:335 by an amino acid substitution of not more than four amino acids wherein X1 is selected from the group consisting of N or Q, X2 is selected from the group consisting of D or E, X3 is selected from the group consisting of G or A, and X4 is selected from the group consisting of T or K, X5 is selected from the group consisting of L or V, X6 is selected from the group consisting of D or E, X7 is selected from the group consisting of L or V, and X8 is selected from the group consisting of S or G, and a variable light chain comprising the amino acid sequence of SEQ ID NO.:15 which differs in amino sequence from the CDRL1 SEQ ID NO.:336 by an amino acid substitution of not more than four amino acids wherein X1 is selected from the group consisting of K or R, X2 is selected from the group consisting of D or S, X3 is selected from the group consisting of V or I, X4 is selected from the group consisting of S or T, and X5 is selected from the group consisting of V and L, and/or which differs in amino acid sequence from the CDRL2 SEQ ID NO.:337 by an amino acid substitution of not more than five amino acids wherein X1 is selected from the group consisting of S or A, X2 is selected from the group consisting of Y or S, X3 is selected from the group consisting of R or L, X4 is selected from the group consisting of Y and Q, and X5 is selected from the group consisting of S or T; or xii) a variable heavy chain comprising the amino acid sequence of SEQ ID NO.:70 which differs in amino acid sequence from the CDRH2 SEQ ID NO.:338 by an amino acid substitution of not more than one amino acids wherein X1 is selected from the group consisting of Y or I, and a variable light chain comprising the amino acid sequence of SEQ ID NO.:75 which differs in amino acid sequence from the CDRL1 SEQ ID NO.:669 by an amino acid substitution of not more than one amino acids wherein X1 is selected from the group consisting of N or Q, and which differs in amino acid sequence from the CDRL2 SEQ ID NO.:339 by an amino acid substitution of not more than one amino acids wherein X1 is selected from the group consisting of L or G; or xiii) a variable heavy chain region VH comprising an amino acid sequence that is at least about 95%, 96%, 97%, 98%, 99%, or 100% identical to the amino acid sequence select from the group consisting of SEQ ID NO.:10, SEQ ID NO.:20, SEQ ID NO.:30, SEQ ID NO.:40, SEQ ID NO.:50, and SEQ ID NO.:60 and a light chain variable region VL comprising an amino acid sequence that is at least about 95%, 96%, 97%, 98%, 99%, or 100% identical to the amino acid sequence select from the group consisting of SEQ ID NO.:15, SEQ ID NO.:25, SEQ ID NO.:35, SEQ ID NO.:45, SEQ ID NO.:55, SEQ ID NO.:65; or xiv) a variable heavy chain region VH comprising an amino acid sequence that is at least about 95%, 96%, 97%, 98%, 99%, or 100% identical to the amino acid sequence select from the group consisting of SEQ ID NO.:70, SEQ ID NO.:80, SEQ ID NO.:90, and SEQ ID NO.:100, and a light chain variable region VL comprising an amino acid sequence that is at least about 95%, 96%, 97%, 98%, 99%, or 100% identical to the amino acid sequence select from the group consisting of SEQ ID NO.:75, SEQ ID NO.:85, SEQ ID NO.:95, and SEQ ID NO.:105; or (xv) a CD137 antigen binding molecule which binds an epitope on CD137 in the extracellular domain CRD3 between amino acids 87-118 (SEQ ID NO.:352) and blocks binding and/or competes for binding with any of the above antigen binding molecules (i)-(xiv); or (xvi) a CD137 antigen binding molecule which binds to an epitope on CD137 in the extracellular domain CRD2/CRD3 between amino acids 46-117 (SEQ ID NO.:356) and blocks binding and/or competes for binding with any of the above antigen binding molecules (i)-(xiv).

In a preferred embodiment of the binding molecule of the invention, the antigen binding site that binds specifically to Fibroblast Activation Protein (FAP) is selected from a group of scFvs comprising:

i) heavy chain CDRs comprising the amino acid sequences of SEQ ID NO.:319 (CDR1), SEQ ID NO.: 108 (CDR2) and SEQ ID NO.:109 (CDR3) and light chain CDRs comprising the amino acid sequences of SEQ ID NO.:111 (CDR1), SEQ ID NO.:112 (CDR2) and SEQ ID NO.:113 (CDR3); or ii) heavy chain CDRs comprising the amino acid sequences of SEQ ID NO.:319 (CDR1), SEQ ID NO.: 117 (CDR2) and SEQ ID NO.:109 (CDR3) and light chain CDRs comprising the amino acid sequences of SEQ ID NO.:120 (CDR1), SEQ ID NO.:112 (CDR2) and SEQ ID NO.:113 (CDR3); or iii) heavy chain CDRs comprising the amino acid sequences of SEQ ID NO.:319 (CDR1), SEQ ID NO.: 126 (CDR2) and SEQ ID NO.:109 (CDR3) and light chain CDRs comprising the amino acid sequences of SEQ ID NO.:129 (CDR1), SEQ ID NO.:112 (CDR2) and SEQ ID NO.:113 (CDR3); or iv) heavy chain CDRs comprising the amino acid sequences of SEQ ID NO.:328 (CDR1), SEQ ID NO.: 135 (CDR2) and SEQ ID NO.:136 (CDR3) and light chain CDRs comprising the amino acid sequences of SEQ ID NO.:138 (CDR1), SEQ ID NO.:139 (CDR2) and SEQ ID NO.:140 (CDR3); or v) heavy chain CDRs comprising the amino acid sequences of SEQ ID NO.:333 (CDR1), SEQ ID NO.: 144 (CDR2) and SEQ ID NO.:145 (CDR3) and light chain CDRs comprising the amino acid sequences of SEQ ID NO.:138 (CDR1), SEQ ID NO.:139 (CDR2) and SEQ ID NO.:140 (CDR3); or vi) heavy chain CDRs comprising the amino acid sequences of SEQ ID NO.:319 (CDR1), SEQ ID NO.: 341 (CDR2) wherein X1 is selected from D or E, and SEQ ID NO.:109 (CDR3) and light chain CDRs comprising the amino acid sequences of SEQ ID NO.:691 (CDR1) wherein X1 is selected from the group consisting of N, R, or S, and X2 is selected from is selected from N or S, and SEQ ID NO:112 (CDR2), and SEQ ID NO.:113 (CDR3); or vii) heavy chain CDRs comprising the amino acid sequences of SEQ ID NO.:694 (CDR1) wherein X1 is selected from the group consisting of S or N, SEQ ID NO.:342 (CDR2) wherein X1 is selected from the group consisting of D or E, and SEQ ID NO.:343 (CDR3) wherein X1 is selected from N or E, and light chain CDRs comprising the amino acid sequences of SEQ ID NO.:138 (CDR1), and SEQ ID NO.:139 (CDR2) and SEQ ID NO.:140 (CDR3); or In a preferred embodiment of the binding molecule of the invention, the antigen binding site that binds specifically to Fibroblast activation protein (FAP) is selected from a group of scFvs comprising:

i) a variable heavy chain comprising the amino acid sequence of SEQ ID NO.:106 and a variable light chain comprising the amino acid sequence of SEQ ID NO.: 110; or ii) a variable heavy chain comprising the amino acid sequence of SEQ ID NO.:115 and a variable light chain comprising the amino acid sequence of SEQ ID NO.: 119; or iii) a variable heavy chain comprising the amino acid sequence of SEQ ID NO.:124 and a variable light chain comprising the amino acid sequence of SEQ ID NO.: 128; or iv) a variable heavy chain comprising the amino acid sequence of SEQ ID NO.:133 and a variable light chain comprising the amino acid sequence of SEQ ID NO.: 137; or v) a variable heavy chain comprising the amino acid sequence of SEQ ID NO.:142 and a variable light chain comprising the amino acid sequence of SEQ ID NO.: 146; or vi) a variable heavy chain comprising the amino acid sequence of SEQ ID NO.:106 which differs in amino acid sequence from the CDRH2 SEQ ID NO.:341 by an amino acid substitution of not more than one amino acids wherein X1 is selected from D or E, and a variable light chain comprising the amino acid sequence of SEQ ID NO.:110 which differs in amino acid sequence from the CDRL1 SEQ ID NO.:691 by an amino acid substitution of not more than two amino acids wherein X1 is selected from the group consisting of N, R, or S, and X2 is selected from is selected from N or S; or vii) a variable heavy chain comprising the amino acid sequence of SEQ ID NO.:133 which differs in amino acid sequence from the CDRH1 SEQ ID NO.:694 by an amino acid substitution of not more than one amino acids wherein X1 is selected from the group consisting of S or N, and/or which differs in amino acid sequence from the CDRH2 SEQ ID NO.:342 by an amino acid substitution of not more than one amino acids wherein X1 selected from the group consisting of D or E, and/or which differs in amino acid sequence from the CDRH3 SEQ ID NO.:343 by an amino acid substitution of not more than one amino acids wherein X1 is selected from the group consisting of N or E, and a variable light chain comprising the amino acid sequence of SEQ ID NO.:137; or viii) a variable heavy chain region VH comprising an amino acid sequence that is at least about 95%, 96%, 97%, 98%, 99%, or 100% identical to the amino acid sequence select from the group consisting of SEQ ID NO.:106, SEQ ID NO.:115, and SEQ ID NO.:124, and a light chain variable region VL comprising an amino acid sequence that is at least about 95%, 96%, 97%, 98%, 99%, or 100% identical to the amino acid sequence select from the group consisting of SEQ ID NO.:110, SEQ ID NO.:119, and SEQ ID NO.:128; or viv) a variable heavy chain region VH comprising an amino acid sequence that is at least about 95%, 96%, 97%, 98%, 99%, or 100% identical to the amino acid sequence select from the group consisting of SEQ ID NO.:133 and SEQ ID NO.:142, and a light chain variable region VL comprising an amino acid sequence that is at least about 95%, 96%, 97%, 98%, 99%, or 100% identical to the amino acid sequence select from the group consisting of SEQ ID NO.:137 and SEQ ID NO.:146.

A preferred embodiment of the immunoglobulin-like binding molecule of the invention, comprises a first antigen binding site that binds specifically to CD137 (4-1BB) and a second antigen binding site that binds specifically to Fibroblast Activation Protein (FAP) selected from a group comprising:

i) (a) a CD137 binding site comprising heavy chain CDRs comprising the amino acid sequences of SEQ ID NO.: 290 (CDR1), SEQ ID NO.:8 (CDR2) and SEQ ID NO.:9 (CDR3) and light chain CDRs comprising the amino acid sequences of SEQ ID NO.:12 (CDR1), SEQ ID NO.:13 (CDR2) and SEQ ID NO.:14 (CDR3); and
(b) a FAP binding site comprising heavy chain CDRs comprising the amino acid sequences of SEQ ID NO.: 319 (CDR1), SEQ ID NO.:108 (CDR2) and SEQ ID NO.:109 (CDR3) and light chain CDRs comprising the amino acid sequences of SEQ ID NO.:111 (CDR1), SEQ ID NO.112 (CDR2) and SEQ ID NO.:113 (CDR3); or ii) (a) a CD137 binding site comprising heavy chain CDRs comprising the amino acid sequences of SEQ ID NO.:290 (CDR1), SEQ ID NO.:8 (CDR2) and SEQ ID NO.:9 (CDR3) and light chain CDRs comprising the amino acid sequences of SEQ ID NO.:12 (CDR1), SEQ ID NO.:13 (CDR2) and SEQ ID NO.:14 (CDR3); and
(b) a FAP binding site comprising heavy chain CDRs comprising the amino acid sequences of SEQ ID NO.: 319 (CDR1), SEQ ID NO.:117 (CDR2) and SEQ ID NO.:109 (CDR3) and light chain CDRs comprising the amino acid sequences of SEQ ID NO.:120 (CDR1), SEQ ID NO.:112 (CDR2) and SEQ ID NO.:113 (CDR3); or iii) (a) a CD137 binding site comprising heavy chain CDRs comprising the amino acid sequences of SEQ ID NO.:290 (CDR1), SEQ ID NO.:8 (CDR2) and SEQ ID NO.:9 (CDR3) and light chain CDRs comprising the amino acid sequences of SEQ ID NO.:12 (CDR1), SEQ ID NO.:13 (CDR2) and SEQ ID NO.:14 (CDR3); and
(b) a FAP binding site comprising heavy chain CDRs comprising the amino acid sequences of SEQ ID NO.: 319 (CDR1), SEQ ID NO.:126 (CDR2) and SEQ ID NO.:109 (CDR3) and light chain CDRs comprising the amino acid sequences of SEQ ID NO.:129 (CDR1), SEQ ID NO.:112 (CDR2) and SEQ ID NO.:113 (CDR3); or iv) (a) a CD137 binding site comprising heavy chain CDRs comprising the amino acid sequences of SEQ ID NO.:290 (CDR1), SEQ ID NO.:8 (CDR2) and SEQ ID NO.:9 (CDR3) and light chain CDRs comprising the amino acid sequences of SEQ ID NO.:12 (CDR1), SEQ ID NO.:13 (CDR2) and SEQ ID NO.:14 (CDR3); and
(b) a FAP binding site comprising heavy chain CDRs comprising the amino acid sequences of SEQ ID NO.: 328 (CDR1), SEQ ID NO.:135 (CDR2) and SEQ ID NO.:136 (CDR3) and light chain CDRs comprising the amino acid sequences of SEQ ID NO.:138 (CDR1), SEQ ID NO.139 (CDR2) and SEQ ID NO.:140 (CDR3); or v) (a) a CD137 binding site comprising heavy chain CDRs comprising the amino acid sequences of SEQ ID NO.:290 (CDR1), SEQ ID NO.:8 (CDR2) and SEQ ID NO.:9 (CDR3) and light chain CDRs comprising the amino acid sequences of SEQ ID NO.:12 (CDR1), SEQ ID NO.:13 (CDR2) and SEQ ID NO.:14 (CDR3); and
(b) a FAP binding site comprising heavy chain CDRs comprising the amino acid sequences of SEQ ID NO.: 333 (CDR1), SEQ ID NO.:144 (CDR2) and SEQ ID NO.:145 (CDR3) and light chain CDRs comprising the amino acid sequences of SEQ ID NO.:138 (CDR1), SEQ ID NO.:139 (CDR2) and SEQ ID NO.:140 (CDR3); or (vi) (a) a CD137 binding site comprising heavy chain CDRs comprising the amino acid sequences of SEQ ID NO.:295 (CDR1), SEQ ID NO.:18 (CDR2) and SEQ ID NO.: 9 (CDR3) and light chain CDRs comprising the amino acid sequences of SEQ ID NO.:22 (CDR1), SEQ ID NO.:23 (CDR2) and SEQ ID NO.:14 (CDR3); and
(b) a FAP binding site comprising heavy chain CDRs comprising the amino acid sequences of SEQ ID NO.: 319 (CDR1), SEQ ID NO.:108 (CDR2) and SEQ ID NO.:109 (CDR3) and light chain CDRs comprising the amino acid sequences of SEQ ID NO.:111 (CDR1), SEQ ID NO.:112 (CDR2) and SEQ ID NO.:113 (CDR3); or (vii) (a) a CD137 binding site comprising heavy chain CDRs comprising the amino acid sequences of SEQ ID NO.:295 (CDR1), SEQ ID NO.:18 (CDR2) and SEQ ID NO.: 9 (CDR3) and light chain CDRs comprising the amino acid sequences of SEQ ID NO.:22 (CDR1), SEQ ID NO.:23 (CDR2) and SEQ ID NO.:14 (CDR3); and
(b) a FAP binding site comprising heavy chain CDRs comprising the amino acid sequences of SEQ ID NO.: 319 (CDR1), SEQ ID NO.:117 (CDR2) and SEQ ID NO.:109 (CDR3) and light chain CDRs comprising the amino acid sequences of SEQ ID NO.:120 (CDR1), SEQ ID NO.:112 (CDR2) and SEQ ID NO.:113 (CDR3); or (viii) (a) a CD137 binding site comprising heavy chain CDRs comprising the amino acid sequences of SEQ ID NO.:295 (CDR1), SEQ ID NO.:18 (CDR2) and SEQ ID NO.:9 (CDR3) and light chain CDRs comprising the amino acid sequences of SEQ ID NO.:22 (CDR1), SEQ ID NO.:23 (CDR2) and SEQ ID NO.:14 (CDR3); and
(b) a FAP binding site comprising heavy chain CDRs comprising the amino acid sequences of SEQ ID NO.: 319 (CDR1), SEQ ID NO.:126 (CDR2) and SEQ ID NO.:109 (CDR3) and light chain CDRs comprising the amino acid sequences of SEQ ID NO.:129 (CDR1), SEQ ID NO.:112 (CDR2) and SEQ ID NO.:113 (CDR3); or (ix) (a) a CD137 binding site comprising heavy chain CDRs comprising the amino acid sequences of SEQ ID NO.:295 (CDR1), SEQ ID NO.:18 (CDR2) and SEQ ID NO.: 9 (CDR3) and light chain CDRs comprising the amino acid sequences of SEQ ID NO.:22 (CDR1), SEQ ID NO.:23 (CDR2) and SEQ ID NO.:14 (CDR3); and
(b) a FAP binding site comprising heavy chain CDRs comprising the amino acid sequences of SEQ ID NO.: 328 (CDR1), SEQ ID NO.:135 (CDR2) and SEQ ID NO.:136 (CDR3) and light chain CDRs comprising the amino acid sequences of SEQ ID NO.:138 (CDR1), SEQ ID NO.:139 (CDR2) and SEQ ID NO.:140 (CDR3); or (x) (a) a CD137 binding site comprising heavy chain CDRs comprising the amino acid sequences of SEQ ID NO.:295 (CDR1), SEQ ID NO.:18 (CDR2) and SEQ ID NO.: 9 (CDR3) and light chain CDRs comprising the amino acid sequences of SEQ ID NO.:22 (CDR1), SEQ ID NO.:23 (CDR2) and SEQ ID NO.:14 (CDR3); and (b) a FAP binding site comprising heavy chain CDRs comprising the amino acid sequences of SEQ ID NO.: 333 (CDR1), SEQ ID NO.:144 (CDR2) and SEQ ID NO.:145 (CDR3) and light chain CDRs comprising the amino acid sequences of SEQ ID NO.:138 (CDR1), SEQ ID NO.:139 (CDR2) and SEQ ID NO.:140 (CDR3); or (xi) (a) a CD137 binding site comprising heavy chain CDRs comprising the amino acid sequences of SEQ ID NO.:295 (CDR1), SEQ ID NO.:28 (CDR2) and SEQ ID NO.:9 (CDR3) and light chain CDRs comprising the amino acid sequences of SEQ ID NO.:32 (CDR1), SEQ ID NO.:33 (CDR2) and SEQ ID NO.:14 (CDR3); and (b) a FAP binding site comprising heavy chain CDRs comprising the amino acid sequences of SEQ ID NO.: 319 (CDR1), SEQ ID NO.:108 (CDR2) and SEQ ID NO.:109 (CDR3) and light chain CDRs comprising the amino acid sequences of SEQ ID NO.:111 (CDR1), SEQ ID NO.:112 (CDR2) and SEQ ID NO.:113 (CDR3); or (xii) (a) a CD137 binding site comprising heavy chain CDRs comprising the amino acid sequences of SEQ ID NO.:295 (CDR1), SEQ ID NO.:28 (CDR2) and SEQ ID NO.:9 (CDR3) and light chain CDRs comprising the amino acid sequences of SEQ ID NO.:32 (CDR1), SEQ ID NO.:33 (CDR2) and SEQ ID NO.:14 (CDR3); and (b) a FAP binding site comprising heavy chain CDRs comprising the amino acid sequences of SEQ ID NO.: 319 (CDR1), SEQ ID NO.:117 (CDR2) and SEQ ID NO.:109 (CDR3) and light chain CDRs comprising the amino acid sequences of SEQ ID NO.:120 (CDR1), SEQ ID NO.:112 (CDR2) and SEQ ID NO.:113 (CDR3); or (xiii) (a) a CD137 binding site comprising heavy chain CDRs comprising the amino acid sequences of SEQ ID NO.:295 (CDR1), SEQ ID NO.:28 (CDR2) and SEQ ID NO.:9 (CDR3) and light chain CDRs comprising the amino acid sequences of SEQ ID NO.:32 (CDR1), SEQ ID NO.:33 (CDR2) and SEQ ID NO.:14 (CDR3); and (b) a FAP binding site comprising heavy chain CDRs comprising the amino acid sequences of SEQ ID NO.: 319 (CDR1), SEQ ID NO.:126 (CDR2) and SEQ ID NO.:109 (CDR3) and light chain CDRs comprising the amino acid sequences of SEQ ID NO.:129 (CDR1), SEQ ID NO.:112 (CDR2) and SEQ ID NO.:113 (CDR3); or (xiv) (a) a CD137 binding site comprising heavy chain CDRs comprising the amino acid sequences of SEQ ID NO.:295 (CDR1), SEQ ID NO.:28 (CDR2) and SEQ ID NO.:9 (CDR3) and light chain CDRs comprising the amino acid sequences of SEQ ID NO.:32 (CDR1), SEQ ID NO.:33 (CDR2) and SEQ ID NO.:14 (CDR3); and (b) a FAP binding site comprising heavy chain CDRs comprising the amino acid sequences of SEQ ID NO.: 328 (CDR1), SEQ ID NO.:135 (CDR2) and SEQ ID NO.:136 (CDR3) and light chain CDRs comprising the amino acid sequences of SEQ ID NO.:138 (CDR1), SEQ ID NO.:139 (CDR2) and SEQ ID NO.:140 (CDR3); or (xv) (a) a CD137 binding site comprising heavy chain CDRs comprising the amino acid sequences of SEQ ID NO.:295 (CDR1), SEQ ID NO.:28 (CDR2) and SEQ ID NO.:9 (CDR3) and light chain CDRs comprising the amino acid sequences of SEQ ID NO.:32 (CDR1), SEQ ID NO.:33 (CDR2) and SEQ ID NO.:14 (CDR3); and (b) a FAP binding site comprising heavy chain CDRs comprising the amino acid sequences of SEQ ID NO.: 333 (CDR1), SEQ ID NO.:144 (CDR2) and SEQ ID NO.:145 (CDR3) and light chain CDRs comprising the amino acid sequences of SEQ ID NO.:138 (CDR1), SEQ ID NO.:139 (CDR2) and SEQ ID NO.:140 (CDR3); or (xvi) (a) a CD137 binding site comprising heavy chain CDRs comprising the amino acid sequences of SEQ ID NO.:295 (CDR1), SEQ ID NO.:38 (CDR2) and SEQ ID NO.:9 (CDR3) and light chain CDRs comprising the amino acid sequences of SEQ ID NO.:42 (CDR1), SEQ ID NO.:43 (CDR2) and SEQ ID NO.:14 (CDR3); and (b) a FAP binding site comprising heavy chain CDRs comprising the amino acid sequences of SEQ ID NO.: 319 (CDR1), SEQ ID NO.:108 (CDR2) and SEQ ID NO.:109 (CDR3) and light chain CDRs comprising the amino acid sequences of SEQ ID NO.:111 (CDR1), SEQ ID NO.:112 (CDR2) and SEQ ID NO.:113 (CDR3); or (xvii) (a) a CD137 binding site comprising heavy chain CDRs comprising the amino acid sequences of SEQ ID NO.:295 (CDR1), SEQ ID NO.:38 (CDR2) and SEQ ID NO.:9 (CDR3) and light chain CDRs comprising the amino acid sequences of SEQ ID NO.:42 (CDR1), SEQ ID NO.:43 (CDR2) and SEQ ID NO.:14 (CDR3); and (b) a FAP binding site comprising heavy chain CDRs comprising the amino acid sequences of SEQ ID NO.: 319 (CDR1), SEQ ID NO.:117 (CDR2) and SEQ ID NO.:109 (CDR3) and light chain CDRs comprising the amino acid sequences of SEQ ID NO.:120 (CDR1), SEQ ID NO.:112 (CDR2) and SEQ ID NO.:113 (CDR3); or (xviii) (a) a CD137 binding site comprising heavy chain CDRs comprising the amino acid sequences of SEQ ID NO.:295 (CDR1), SEQ ID NO.:38 (CDR2) and SEQ ID NO.:9 (CDR3) and light chain CDRs comprising the amino acid sequences of SEQ ID NO.:42 (CDR1), SEQ ID NO.:43 (CDR2) and SEQ ID NO.:14 (CDR3); and (b) a FAP binding site comprising heavy chain CDRs comprising the amino acid sequences of SEQ ID NO.: 319 (CDR1), SEQ ID NO.:126 (CDR2) and SEQ ID NO.:109 (CDR3) and light chain CDRs comprising the amino acid sequences of SEQ ID NO.:129 (CDR1), SEQ ID NO.:112 (CDR2) and SEQ ID NO.:113 (CDR3); or (xix) (a) a CD137 binding site comprising heavy chain CDRs comprising the amino acid sequences of SEQ ID NO.:295 (CDR1), SEQ ID NO.:38 (CDR2) and SEQ ID NO.:9 (CDR3) and light chain CDRs comprising the amino acid sequences of SEQ ID NO.:42 (CDR1), SEQ ID NO.:43 (CDR2) and SEQ ID NO.:14 (CDR3); and (b) a FAP binding site comprising heavy chain CDRs comprising the amino acid sequences of SEQ ID NO.: 328 (CDR1), SEQ ID NO.:135 (CDR2) and SEQ ID NO.:136 (CDR3) and light chain CDRs comprising the amino acid sequences of SEQ ID NO.:138 (CDR1), SEQ ID NO.:139 (CDR2) and SEQ ID NO.:140 (CDR3); or (xx) (a) a CD137 binding site comprising heavy chain CDRs comprising the amino acid sequences of SEQ ID NO.:295 (CDR1), SEQ ID NO.:38 (CDR2) and SEQ ID NO.:9 (CDR3) and light chain CDRs comprising the amino acid sequences of SEQ ID NO.:42 (CDR1), SEQ ID NO.:43 (CDR2) and SEQ ID NO.:14 (CDR3); and (b) a FAP binding site comprising heavy chain CDRs comprising the amino acid sequences of SEQ ID NO.: 333 (CDR1), SEQ ID NO.:144 (CDR2) and SEQ ID NO.:145 (CDR3) and light chain CDRs comprising the amino acid sequences of SEQ ID NO.:138 (CDR1), SEQ ID NO.:139 (CDR2) and SEQ ID NO.:140 (CDR3); or (xxi) (a) a CD137 binding site comprising heavy chain CDRs comprising the amino acid sequences of SEQ ID NO.:295 (CDR1), SEQ ID NO.:48 (CDR2) and SEQ ID NO.: 9 (CDR3) and light chain CDRs comprising the amino acid sequences of SEQ ID NO.:52 (CDR1), SEQ ID NO.:53 (CDR2) and SEQ ID NO.:14 (CDR3); and (b) a FAP binding site comprising heavy chain CDRs comprising the amino acid sequences of SEQ ID NO.: 319 (CDR1), SEQ ID NO.:108 (CDR2) and SEQ ID NO.:109 (CDR3) and light chain CDRs comprising the amino acid sequences of SEQ ID NO.:111 (CDR1), SEQ ID NO.:111 (CDR2) and SEQ ID NO.:113 (CDR3); or (xxii) (a) a CD137 binding site comprising heavy chain CDRs comprising the amino acid sequences of SEQ ID NO.:295 (CDR1), SEQ ID NO.:48 (CDR2) and SEQ ID NO.:9 (CDR3) and light chain CDRs comprising the amino acid sequences of SEQ ID NO.:52 (CDR1), SEQ ID NO.:53 (CDR2) and SEQ ID NO.:14 (CDR3); and (b) a FAP binding site comprising heavy chain CDRs comprising the amino acid sequences of SEQ ID NO.: 319 (CDR1), SEQ ID NO.:117 (CDR2) and SEQ ID NO.:109 (CDR3) and light chain CDRs comprising the amino acid sequences of SEQ ID NO.:120 (CDR1), SEQ ID NO.:112 (CDR2) and SEQ ID NO.:113 (CDR3); or (xxiii) (a) a CD137 binding site comprising heavy chain CDRs comprising the amino acid sequences of SEQ ID NO.:295 (CDR1), SEQ ID NO.:48 (CDR2) and SEQ ID NO.:9 (CDR3) and light chain CDRs comprising the amino acid sequences of SEQ ID NO.:52 (CDR1), SEQ ID NO.:53 (CDR2) and SEQ ID NO.:14 (CDR3); and (b) a FAP binding site comprising heavy chain CDRs comprising the amino acid sequences of SEQ ID NO.: 319 (CDR1), SEQ ID NO.:126 (CDR2) and SEQ ID NO.:109 (CDR3) and light chain CDRs comprising the amino acid sequences of SEQ ID NO.:129 (CDR1), SEQ ID NO.:112 (CDR2) and SEQ ID NO.:113 (CDR3); or (xxiv) (a) a CD137 binding site comprising heavy chain CDRs comprising the amino acid sequences of SEQ ID NO.:295 (CDR1), SEQ ID NO.:48 (CDR2) and SEQ ID NO.: 9 (CDR3) and light chain CDRs comprising the amino acid sequences of SEQ ID NO.:52 (CDR1), SEQ ID NO.:53 (CDR2) and SEQ ID NO.:14 (CDR3); and (b) a FAP binding site comprising heavy chain CDRs comprising the amino acid sequences of SEQ ID NO.: 328 (CDR1), SEQ ID NO.:135 (CDR2) and SEQ ID NO.:136 (CDR3) and light chain CDRs comprising the amino acid sequences of SEQ ID NO.:138 (CDR1), SEQ ID NO.:139 (CDR2) and SEQ ID NO.:140 (CDR3); or (xxv) (a) a CD137 binding site comprising heavy chain CDRs comprising the amino acid sequences of SEQ ID NO.:295 (CDR1), SEQ ID NO.:48 (CDR2) and SEQ ID NO.:9 (CDR3) and light chain CDRs comprising the amino acid sequences of SEQ ID NO.:52 (CDR1), SEQ ID NO.:53 (CDR2) and SEQ ID NO.:14 (CDR3); and (b) a FAP binding site comprising heavy chain CDRs comprising the amino acid sequences of SEQ ID NO.: 333 (CDR1), SEQ ID NO.:144 (CDR2) and SEQ ID NO.:145 (CDR3) and light chain CDRs comprising the amino acid sequences of SEQ ID NO.:138 (CDR1), SEQ ID NO.:139 (CDR2) and SEQ ID NO.:140 (CDR3); or (xxvi) (a) a CD137 binding site comprising heavy chain CDRs comprising the amino acid sequences of SEQ ID NO.:295 (CDR1), SEQ ID NO.:58 (CDR2) and SEQ ID NO.:9 (CDR3) and light chain CDRs comprising the amino acid sequences of SEQ ID NO.:62 (CDR1), SEQ ID NO.:63 (CDR2) and SEQ ID NO.:14 (CDR3); and (b) a FAP binding site comprising heavy chain CDRs comprising the amino acid sequences of SEQ ID NO.: 319 (CDR1), SEQ ID NO.:108 (CDR2) and SEQ ID NO.:109 (CDR3) and light chain CDRs comprising the amino acid sequences of SEQ ID NO.:111 (CDR1), SEQ ID NO.:111 (CDR2) and SEQ ID NO.:113 (CDR3); or (xxvii) (a) a CD137 binding site comprising heavy chain CDRs comprising the amino acid sequences of SEQ ID NO.:295 (CDR1), SEQ ID NO.:58 (CDR2) and SEQ ID NO.:9 (CDR3) and light chain CDRs comprising the amino acid sequences of SEQ ID NO.:62 (CDR1), SEQ ID NO.:63 (CDR2) and SEQ ID NO.:14 (CDR3); and (b) a FAP binding site comprising heavy chain CDRs comprising the amino acid sequences of SEQ ID NO.: 319 (CDR1), SEQ ID NO.:117 (CDR2) and SEQ ID NO.:109 (CDR3) and light chain CDRs comprising the amino acid sequences of SEQ ID NO.:120 (CDR1), SEQ ID NO.:112 (CDR2) and SEQ ID NO.:113 (CDR3); or (xxviii) (a) a CD137 binding site comprising heavy chain CDRs comprising the amino acid sequences of SEQ ID NO.:295 (CDR1), SEQ ID NO.:58 (CDR2) and SEQ ID NO.:9 (CDR3) and light chain CDRs comprising the amino acid sequences of SEQ ID NO.:62 (CDR1), SEQ ID NO.:63 (CDR2) and SEQ ID NO.:14 (CDR3); and (b) a FAP binding site comprising heavy chain CDRs comprising the amino acid sequences of SEQ ID NO.: 319 (CDR1), SEQ ID NO.:126 (CDR2) and SEQ ID NO.:109 (CDR3) and light chain CDRs comprising the amino acid sequences of SEQ ID NO.:129 (CDR1), SEQ ID NO.:112 (CDR2) and SEQ ID NO.:113 (CDR3); or (xxix) (a) a CD137 binding site comprising heavy chain CDRs comprising the amino acid sequences of SEQ ID NO.:295 (CDR1), SEQ ID NO.:58 (CDR2) and SEQ ID NO.:9 (CDR3) and light chain CDRs comprising the amino acid sequences of SEQ ID NO.:62 (CDR1), SEQ ID NO.:63 (CDR2) and SEQ ID NO.:14 (CDR3); and (b) a FAP binding site comprising heavy chain CDRs comprising the amino acid sequences of SEQ ID NO.: 328 (CDR1), SEQ ID NO.:135 (CDR2) and SEQ ID NO.:136 (CDR3) and light chain CDRs comprising the amino acid sequences of SEQ ID NO.:138 (CDR1), SEQ ID NO.:139 (CDR2) and SEQ ID NO.:140 (CDR3); or (xxx) (a) a CD137 binding site comprising heavy chain CDRs comprising the amino acid sequences of SEQ ID NO.:295 (CDR1), SEQ ID NO.:58 (CDR2) and SEQ ID NO.:9 (CDR3) and light chain CDRs comprising the amino acid sequences of SEQ ID NO.:62 (CDR1), SEQ ID NO.:63 (CDR2) and SEQ ID NO.:14 (CDR3); and (b) a FAP binding site comprising heavy chain CDRs comprising the amino acid sequences of SEQ ID NO.: 333 (CDR1), SEQ ID NO.:144 (CDR2) and SEQ ID NO.:145 (CDR3) and light chain CDRs comprising the amino acid sequences of SEQ ID NO.:138 (CDR1), SEQ ID NO.:139 (CDR2) and SEQ ID NO.:140 (CDR3); or (xxxi) (a) a CD137 binding site comprising heavy chain CDRs comprising the amino acid sequences of SEQ ID NO.:308 (CDR1), SEQ ID NO.:68 (CDR2) and SEQ ID NO.:69 (CDR3) and light chain CDRs comprising the amino acid sequences of SEQ ID NO.:72 (CDR1), SEQ ID NO.:73 (CDR2) and SEQ ID NO.:74 (CDR3); and (b) a FAP binding site comprising heavy chain CDRs comprising the amino acid sequences of SEQ ID NO.:319 (CDR1), SEQ ID NO.:108 (CDR2) and SEQ ID NO.:109 (CDR3) and light chain CDRs comprising the amino acid sequences of SEQ ID NO.:111 (CDR1), SEQ ID NO.112 (CDR2) and SEQ ID NO.:113 (CDR3); or (xxxii) (a) a CD137 binding site comprising heavy chain CDRs comprising the amino acid sequences of SEQ ID NO.:308 (CDR1), SEQ ID NO.:68 (CDR2) and SEQ ID NO.:69 (CDR3) and light chain CDRs comprising the amino acid sequences of SEQ ID NO.:72 (CDR1), SEQ ID NO.:73 (CDR2) and SEQ ID NO.:74 (CDR3); and (b) a FAP binding site comprising heavy chain CDRs comprising the amino acid sequences of SEQ ID NO.:319 (CDR1), SEQ ID NO.:117 (CDR2) and SEQ ID NO.:109 (CDR3) and light chain CDRs comprising the amino acid sequences of SEQ ID NO.:120 (CDR1), SEQ ID NO.:112 (CDR2) and SEQ ID NO.:113 (CDR3); or (xxxiii) (a) a CD137 binding site comprising heavy chain CDRs comprising the amino acid sequences of SEQ ID NO.:308 (CDR1), SEQ ID NO.:68 (CDR2) and SEQ ID NO.:69 (CDR3) and light chain CDRs comprising the amino acid sequences of SEQ ID NO.:72 (CDR1), SEQ ID NO.:73 (CDR2) and SEQ ID NO.:74 (CDR3); and (b) a FAP binding site comprising heavy chain CDRs comprising the amino acid sequences of SEQ ID NO.:319 (CDR1), SEQ ID NO.:126 (CDR2) and SEQ ID NO.:109 (CDR3) and light chain CDRs comprising the amino acid sequences of SEQ ID NO.:129 (CDR1), SEQ ID NO.:112 (CDR2) and SEQ ID NO.:113 (CDR3); or (xxxiv) (a) a CD137 binding site comprising heavy chain CDRs comprising the amino acid sequences of SEQ ID NO.:308 (CDR1), SEQ ID NO.:68 (CDR2) and SEQ ID NO.:69 (CDR3) and light chain CDRs comprising the amino acid sequences of SEQ ID NO.:72 (CDR1), SEQ ID NO.:73 (CDR2) and SEQ ID NO.:74 (CDR3); and (b) a FAP binding site comprising heavy chain CDRs comprising the amino acid sequences of SEQ ID NO.:328 (CDR1), SEQ ID NO.:135 (CDR2) and SEQ ID NO.:136 (CDR3) and light chain CDRs comprising the amino acid sequences of SEQ ID NO.:138 (CDR1), SEQ ID NO.139 (CDR2) and SEQ ID NO.:140 (CDR3); or (xxxv) (a) a CD137 binding site comprising heavy chain CDRs comprising the amino acid sequences of SEQ ID NO.:308 (CDR1), SEQ ID NO.:68 (CDR2) and SEQ ID NO.:69 (CDR3) and light chain CDRs comprising the amino acid sequences of SEQ ID NO.:72 (CDR1), SEQ ID NO.:73 (CDR2) and SEQ ID NO.:74 (CDR3); and (b) a FAP binding site comprising heavy chain CDRs comprising the amino acid sequences of SEQ ID NO.:333 (CDR1), SEQ ID NO.:144 (CDR2) and SEQ ID NO.:145 (CDR3) and light chain CDRs comprising the amino acid sequences of SEQ ID NO.:138 (CDR1), SEQ ID NO.:139 (CDR2) and SEQ ID NO.:140 (CDR3); or (xxxvi) (a) a CD137 binding site comprising heavy chain CDRs comprising the amino acid sequences of SEQ ID NO.:308 (CDR1), SEQ ID NO.:78 (CDR2) and SEQ ID NO.:69 (CDR3) and light chain CDRs comprising the amino acid sequences of SEQ ID NO.:72 (CDR1), SEQ ID NO.:73 (CDR2) and SEQ ID NO.:74 (CDR3); and (b) a FAP binding site comprising heavy chain CDRs comprising the amino acid sequences of SEQ ID NO.:319 (CDR1), SEQ ID NO.:108 (CDR2) and SEQ ID NO.:109 (CDR3) and light chain CDRs comprising the amino acid sequences of SEQ ID NO.:111 (CDR1), SEQ ID NO.:112 (CDR2) and SEQ ID NO.:113 (CDR3); or (xxxvii) (a) a CD137 binding site comprising heavy chain CDRs comprising the amino acid sequences of SEQ ID NO.:308 (CDR1), SEQ ID NO.:78 (CDR2) and SEQ ID NO.:69 (CDR3) and light chain CDRs comprising the amino acid sequences of SEQ ID NO.:72 (CDR1), SEQ ID NO.:73 (CDR2) and SEQ ID NO.:74 (CDR3); and (b) a FAP binding site comprising heavy chain CDRs comprising the amino acid sequences of SEQ ID NO.:319 (CDR1), SEQ ID NO.:117 (CDR2) and SEQ ID NO.:109 (CDR3) and light chain CDRs comprising the amino acid sequences of SEQ ID NO.:120 (CDR1), SEQ ID NO.:112 (CDR2) and SEQ ID NO.:113 (CDR3); or (xxxviii) (a) a CD137 binding site comprising heavy chain CDRs comprising the amino acid sequences of SEQ ID NO.:308 (CDR1), SEQ ID NO.:78 (CDR2) and SEQ ID NO.:69 (CDR3) and light chain CDRs comprising the amino acid sequences of SEQ ID NO.:72 (CDR1), SEQ ID NO.:73 (CDR2) and SEQ ID NO.:74 (CDR3); and (b) a FAP binding site comprising heavy chain CDRs comprising the amino acid sequences of SEQ ID NO.:319 (CDR1), SEQ ID NO.:126 (CDR2) and SEQ ID NO.:109 (CDR3) and light chain CDRs comprising the amino acid sequences of SEQ ID NO.:129 (CDR1), SEQ ID NO.:112 (CDR2) and SEQ ID NO.:113 (CDR3); or (xxxix) (a) a CD137 binding site comprising heavy chain CDRs comprising the amino acid sequences of SEQ ID NO.:308 (CDR1), SEQ ID NO.:78 (CDR2) and SEQ ID NO.:69 (CDR3) and light chain CDRs comprising the amino acid sequences of SEQ ID NO.:72 (CDR1), SEQ ID NO.:73 (CDR2) and SEQ ID NO.:74 (CDR3); and (b) a FAP binding site comprising heavy chain CDRs comprising the amino acid sequences of SEQ ID NO.:328 (CDR1), SEQ ID NO.:135 (CDR2) and SEQ ID NO.:136 (CDR3) and light chain CDRs comprising the amino acid sequences of SEQ ID NO.:138 (CDR1), SEQ ID NO.:139 (CDR2) and SEQ ID NO.:140 (CDR3); or (xl) (a) a CD137 binding site comprising heavy chain CDRs comprising the amino acid sequences of SEQ ID NO.:308 (CDR1), SEQ ID NO.:78 (CDR2) and SEQ ID NO.:69 (CDR3) and light chain CDRs comprising the amino acid sequences of SEQ ID NO.:72 (CDR1), SEQ ID NO.:73 (CDR2) and SEQ ID NO.:74 (CDR3); and (b) a FAP binding site comprising heavy chain CDRs comprising the amino acid sequences of SEQ ID NO.: 333 (CDR1), SEQ ID NO.:144 (CDR2) and SEQ ID NO.:145 (CDR3) and light chain CDRs comprising the amino acid sequences of SEQ ID NO.:138 (CDR1), SEQ ID NO.:139 (CDR2) and SEQ ID NO.:140 (CDR3); or (xli) (a) a CD137 binding site comprising heavy chain CDRs comprising the amino acid sequences of SEQ ID NO.:308 (CDR1), SEQ ID NO.:88 (CDR2) and SEQ ID NO.:69 (CDR3) and light chain CDRs comprising the amino acid sequences of SEQ ID NO.:92 (CDR1), SEQ ID NO.:93 (CDR2) and SEQ ID NO.:74 (CDR3); and (b) a FAP binding site comprising heavy chain CDRs comprising the amino acid sequences of SEQ ID NO.: 319 (CDR1), SEQ ID NO.:108 (CDR2) and SEQ ID NO.:109 (CDR3) and light chain CDRs comprising the amino acid sequences of SEQ ID NO.:111 (CDR1), SEQ ID NO.:112 (CDR2) and SEQ ID NO.:113 (CDR3); or (xlii) (a) a CD137 binding site comprising heavy chain CDRs comprising the amino acid sequences of SEQ ID NO.:308 (CDR1), SEQ ID NO.:88 (CDR2) and SEQ ID NO.:69 (CDR3) and light chain CDRs comprising the amino acid sequences of SEQ ID NO.:92 (CDR1), SEQ ID NO.:93 (CDR2) and SEQ ID NO.:74 (CDR3); and (b) a FAP binding site comprising heavy chain CDRs comprising the amino acid sequences of SEQ ID NO.: 319 (CDR1), SEQ ID NO.:117 (CDR2) and SEQ ID NO.:109 (CDR3) and light chain CDRs comprising the amino acid sequences of SEQ ID NO.:120 (CDR1), SEQ ID NO.:112 (CDR2) and SEQ ID NO.:113 (CDR3); or (xliii) (a) a CD137 binding site comprising heavy chain CDRs comprising the amino acid sequences of SEQ ID NO.:308 (CDR1), SEQ ID NO.:88 (CDR2) and SEQ ID NO.:69 (CDR3) and light chain CDRs comprising the amino acid sequences of SEQ ID NO.:92 (CDR1), SEQ ID NO.:93 (CDR2) and SEQ ID NO.:74 (CDR3); and (b) a FAP binding site comprising heavy chain CDRs comprising the amino acid sequences of SEQ ID NO.: 319 (CDR1), SEQ ID NO.:126 (CDR2) and SEQ ID NO.:109 (CDR3) and light chain CDRs comprising the amino acid sequences of SEQ ID NO.:129 (CDR1), SEQ ID NO.:112 (CDR2) and SEQ ID NO.:113 (CDR3); or (xliv) (a) a CD137 binding site comprising heavy chain CDRs comprising the amino acid sequences of SEQ ID NO.:308 (CDR1), SEQ ID NO.:88 (CDR2) and SEQ ID NO.:69 (CDR3) and light chain CDRs comprising the amino acid sequences of SEQ ID NO.:92 (CDR1), SEQ ID NO.:93 (CDR2) and SEQ ID NO.:74 (CDR3); and (b) a FAP binding site comprising heavy chain CDRs comprising the amino acid sequences of SEQ ID NO.: 328 (CDR1), SEQ ID NO.:135 (CDR2) and SEQ ID NO.:136 (CDR3) and light chain CDRs comprising the amino acid sequences of SEQ ID NO.:138 (CDR1), SEQ ID NO.:139 (CDR2) and SEQ ID NO.:140 (CDR3); or (xlv) (a) a CD137 binding site comprising heavy chain CDRs comprising the amino acid sequences of SEQ ID NO.:308 (CDR1), SEQ ID NO.:88 (CDR2) and SEQ ID NO.:69 (CDR3) and light chain CDRs comprising the amino acid sequences of SEQ ID NO.:92 (CDR1), SEQ ID NO.:93 (CDR2) and SEQ ID NO.:74 (CDR3); and (b) a FAP binding site comprising heavy chain CDRs comprising the amino acid sequences of SEQ ID NO.: 333 (CDR1), SEQ ID NO.:144 (CDR2) and SEQ ID NO.:145 (CDR3) and light chain CDRs comprising the amino acid sequences of SEQ ID NO.:138 (CDR1), SEQ ID NO.:139 (CDR2) and SEQ ID NO.:140 (CDR3); or (xlvi) (a) a CD137 binding site comprising heavy chain CDRs comprising the amino acid sequences of SEQ ID NO.:308 (CDR1), SEQ ID NO.:98 (CDR2) and SEQ ID NO.:69 (CDR3) and light chain CDRs comprising the amino acid sequences of SEQ ID NO.:92 (CDR1), SEQ ID NO.:93 (CDR2) and SEQ ID NO.:74 (CDR3); and (b) a FAP binding site comprising heavy chain CDRs comprising the amino acid sequences of SEQ ID NO.: 319 (CDR1), SEQ ID NO.:108 (CDR2) and SEQ ID NO.:109 (CDR3) and light chain CDRs comprising the amino acid sequences of SEQ ID NO.:111 (CDR1), SEQ ID NO.:112 (CDR2) and SEQ ID NO.:113 (CDR3); or (xlvii) (a) a CD137 binding site comprising heavy chain CDRs comprising the amino acid sequences of SEQ ID NO.:308 (CDR1), SEQ ID NO.:98 (CDR2) and SEQ ID NO.:69 (CDR3) and light chain CDRs comprising the amino acid sequences of SEQ ID NO.:92 (CDR1), SEQ ID NO.:93 (CDR2) and SEQ ID NO.:74 (CDR3); and (b) a FAP binding site comprising heavy chain CDRs comprising the amino acid sequences of SEQ ID NO.: 319 (CDR1), SEQ ID NO.:117 (CDR2) and SEQ ID NO.:109 (CDR3) and light chain CDRs comprising the amino acid sequences of SEQ ID NO.:120 (CDR1), SEQ ID NO.:112 (CDR2) and SEQ ID NO.:113 (CDR3); or (xlviii) (a) a CD137 binding site comprising heavy chain CDRs comprising the amino acid sequences of SEQ ID NO.:308 (CDR1), SEQ ID NO.:98 (CDR2) and SEQ ID NO.:69 (CDR3) and light chain CDRs comprising the amino acid sequences of SEQ ID NO.:92 (CDR1), SEQ ID NO.:93 (CDR2) and SEQ ID NO.:74 (CDR3); and (b) a FAP binding site comprising heavy chain CDRs comprising the amino acid sequences of SEQ ID NO.: 319 (CDR1), SEQ ID NO.:126 (CDR2) and SEQ ID NO.:109 (CDR3) and light chain CDRs comprising the amino acid sequences of SEQ ID NO.:129 (CDR1), SEQ ID NO.:112 (CDR2) and SEQ ID NO.:113 (CDR3); or (xlix) (a) a CD137 binding site comprising heavy chain CDRs comprising the amino acid sequences of SEQ ID NO.:308 (CDR1), SEQ ID NO.:98 (CDR2) and SEQ ID NO.:69 (CDR3) and light chain CDRs comprising the amino acid sequences of SEQ ID NO.:92 (CDR1), SEQ ID NO.:93 (CDR2) and SEQ ID NO.:74 (CDR3); and (b) a FAP binding site comprising heavy chain CDRs comprising the amino acid sequences of SEQ ID NO.: 328 (CDR1), SEQ ID NO.:135 (CDR2) and SEQ ID NO.:136 (CDR3) and light chain CDRs comprising the amino acid sequences of SEQ ID NO.:138 (CDR1), SEQ ID NO.:139 (CDR2) and SEQ ID NO.:140 (CDR3); or (1) (a) a CD137 binding site comprising heavy chain CDRs comprising the amino acid sequences of SEQ ID NO.:308 (CDR1), SEQ ID NO.:98 (CDR2) and SEQ ID NO.:69 (CDR3) and light chain CDRs comprising the amino acid sequences of SEQ ID NO.:92 (CDR1), SEQ ID NO.:93 (CDR2) and SEQ ID NO.:74 (CDR3) and (b) a FAP binding site comprising heavy chain CDRs comprising the amino acid sequences of SEQ ID NO.: 333 (CDR1), SEQ ID NO.:144 (CDR2) and SEQ ID NO.:145 (CDR3) and light chain CDRs comprising the amino acid sequences of SEQ ID NO.:138 (CDR1), SEQ ID NO.:139 (CDR2) and SEQ ID NO.:140 (CDR3); or (li) (a) a CD137 binding site comprising heavy chain CDRs comprising the amino acid sequences of SEQ ID NO.:672 (CDR1) where X1 is A or S, SEQ ID NO.:335 (CDR2) wherein X1 is selected from the group consisting of N or Q, X2 is selected from the group consisting of D or E, X3 is selected from the group consisting of G or A, and X4 is selected from the group consisting of T or K, X5 is selected from the group consisting of L or V, X6 is selected from the group consisting of D or E, X7 is selected from the group consisting of L or V, and X8 is selected from the group consisting of S or G, and SEQ ID NO.:9 (CDR3) and light chain CDRs comprising the amino acid sequences of SEQ ID NO.:336 (CDR1) wherein X1 is selected from the group consisting of K or R, X2 is selected from the group consisting of D or S, X3 is selected from the group consisting of V or I, X4 is selected from the group consisting of S or T, and X5 is selected from the group consisting of V and L, SEQ ID NO.:337 (CDR2) wherein X1 is selected from the group consisting of S or A, X2 is selected from the group consisting of Y or S, X3 is selected from the group consisting of R or L, X4 is selected from the group consisting of Y and Q, and X5 is selected from the group consisting of S or T, and SEQ ID NO.:14 (CDR3); and (b) a FAP binding site comprising heavy chain CDRs comprising the amino acid sequences of SEQ ID NO.: 319 (CDR1), SEQ ID NO.:341 (CDR2) wherein X1 is selected from D or E, and SEQ ID NO.:109 (CDR3) and light chain CDRs comprising the amino acid sequences of SEQ ID NO.:691 (CDR1) wherein X1 is selected from the group consisting of N, R, or S, and X2 is selected from is selected from N or S, SEQ ID NO.:112 (CDR2), and SEQ ID NO.:113 (CDR3); or (lii) (a) a CD137 binding site comprising heavy chain CDRs comprising the amino acid sequences of SEQ ID NO.:672 (CDR1) wherein X1 is selected from the group consisting of A or S, SEQ ID NO.:335 (CDR2) wherein X1 is selected from the group consisting of N or Q, X2 is selected from the group consisting of D or E, X3 is selected from the group consisting of G or A, and X4 is selected from the group consisting of T or K, X5 is selected from the group consisting of L or V, X6 is selected from the group consisting of D or E, X7 is selected from the group consisting of L or V, and X8 is selected from the group consisting of S or G, and SEQ ID NO.:9 (CDR3) and light chain CDRs comprising the amino acid sequences of SEQ ID NO.:336 (CDR1) wherein X1 is selected from the group consisting of K or R, X2 is selected from the group consisting of D or S, X3 is selected from the group consisting of V or I, X4 is selected from the group consisting of S or T, and X5 is selected from the group consisting of V and L, SEQ ID NO.:337 (CDR2) wherein X1 is selected from the group consisting of S or A, X2 is selected from the group consisting of Y or S, X3 is selected from the group consisting of R or L, X4 is selected from the group consisting of Y and Q, and X5 is selected from the group consisting of S or T, and SEQ ID NO.:14 (CDR3); and (b) a FAP binding site comprising heavy chain CDRs comprising the amino acid sequences of SEQ ID NO.: 694 (CDR1) wherein X1 is selected from the group consisting of S or N, SEQ ID NO.:342 (CDR2) wherein X1 is selected from the group consisting of D or E, and SEQ ID NO.:343 (CDR3) wherein X1 is selected from N or E, and light chain CDRs comprising the amino acid sequences of SEQ ID NO.:138 (CDR1), SEQ ID NO.:139 (CDR2), and SEQ ID NO.:140 (CDR3); or (liii) (a) a CD137 binding site comprising heavy chain CDRs comprising the amino acid sequences of SEQ ID NO.:308 (CDR1), SEQ ID NO.:338 (CDR2) wherein X1 is selected from the group consisting of Y or I, and SEQ ID NO.:69 (CDR3) and light chain CDRs comprising the amino acid sequences of SEQ ID NO.:669 (CDR1) wherein X1 is selected from the group consisting of N or Q, SEQ ID NO.:339 (CDR2) wherein X1 is selected from the group consisting of L or G, and SEQ ID NO.:74 (CDR3) and (b) a FAP binding site comprising heavy chain CDRs comprising the amino acid sequences of SEQ ID NO.: 319 (CDR1), SEQ ID NO.:341 (CDR2) wherein X1 is selected from D or E, and SEQ ID NO.:109 (CDR3) and light chain CDRs comprising the amino acid sequences of SEQ ID NO.:691 (CDR1) wherein X1 is selected from the group consisting of N, R, or S, and X2 is selected from is selected from N or S, SEQ ID NO.:112 (CDR2), and SEQ ID NO.:113 (CDR3); or (lix) (a) a CD137 binding site comprising heavy chain CDRs comprising the amino acid sequences of SEQ ID NO.:308 (CDR1), SEQ ID NO.:338 (CDR2) wherein X1 is selected from the group consisting of Y or I, and SEQ ID NO.:69 (CDR3) and light chain CDRs comprising the amino acid sequences of SEQ ID NO.: 669 (CDR1) wherein X1 is selected from the group consisting of N or Q, SEQ ID NO.:339 (CDR2) wherein X1 is selected from the group consisting of L or G, and SEQ ID NO.:74 (CDR3); and (b) a FAP binding site comprising heavy chain CDRs comprising the amino acid sequences of SEQ ID NO.: 694 (CDR1) wherein X1 is selected from the group consisting of S or N, SEQ ID NO.:342 (CDR2) wherein X1 is selected from the group consisting of D or E, and SEQ ID NO.:343 (CDR3) wherein X1 is selected from N or E and light chain CDRs comprising the amino acid sequences of SEQ ID NO.:138 (CDR1), SEQ ID NO.: 139 (CDR2), and SEQ ID NO.:140 (CDR3).

A further aspect of the invention provides an immunoglobulin-like binding molecule comprising (i) an immunoglobulin heavy chain fused to a scFv at its C-terminus comprising the amino acid sequence of SEQ ID NO.:151, and a light chain comprising the amino acid sequence of SEQ ID NO.:152; or (ii) an immunoglobulin heavy chain fused to a scFv at its C-terminus comprising the amino acid sequence of SEQ ID NO.:153, and a light chain comprising the amino acid sequence of SEQ ID NO.:154; or (iii) an immunoglobulin heavy chain fused to a scFv at its C-terminus comprising the amino acid sequence of SEQ ID NO.:155, and a light chain comprising the amino acid sequence of SEQ ID NO.:156; or (iv) an immunoglobulin heavy chain fused to a scFv at its C-terminus comprising the amino acid sequence of SEQ ID NO.:157, and a light chain comprising the amino acid sequence of SEQ ID NO.:158; or (v) an immunoglobulin heavy chain fused to a scFv at its C-terminus comprising the amino acid sequence of SEQ ID NO.:159, and a light chain comprising the amino acid sequence of SEQ ID NO.:160; or (vi) an immunoglobulin heavy chain fused to a scFv at its C-terminus comprising the amino acid sequence of SEQ ID NO.:164, and a light chain comprising the amino acid sequence of SEQ ID NO.: 165; or (vii) an immunoglobulin heavy chain fused to a scFv at its C-terminus comprising the amino acid sequence of SEQ ID NO.:169, and a light chain comprising the amino acid sequence of SEQ ID NO.: 170; or (viii) an immunoglobulin heavy chain fused to a scFv at its C-terminus comprising the amino acid sequence of SEQ ID NO.:174, and a light chain comprising the amino acid sequence of SEQ ID NO.:175; or (ix) an immunoglobulin heavy chain fused to a scFv at its C-terminus comprising the amino acid sequence of SEQ ID NO.:179, and a light chain comprising the amino acid sequence of SEQ ID NO.:180; or (x) an immunoglobulin heavy chain fused to a scFv at its C-terminus comprising the amino acid sequence of SEQ ID NO.:184, and a light chain comprising the amino acid sequence of SEQ ID NO.:185; or (xi) an immunoglobulin heavy chain fused to a scFv at its C-terminus comprising the amino acid sequence of SEQ ID NO.:189, and a light chain comprising the amino acid sequence of SEQ ID NO.:190; or (xii) an immunoglobulin heavy chain fused to a scFv at its C-terminus comprising the amino acid sequence of SEQ ID NO.:194, and a light chain comprising the amino acid sequence of SEQ ID NO.:195; or (xiii) an immunoglobulin heavy chain fused to a scFv at its C-terminus comprising the amino acid sequence of SEQ ID NO.:199, and a light chain comprising the amino acid sequence of SEQ ID NO.:200; or (xiv) an immunoglobulin heavy chain fused to a scFv at its C-terminus comprising the amino acid sequence of SEQ ID NO.:204, and a light chain comprising the amino acid sequence of SEQ ID NO.:205; or (xv) an immunoglobulin heavy chain fused to a scFv at its C-terminus comprising the amino acid sequence of SEQ ID NO.:209, and a light chain comprising the amino acid sequence of SEQ ID NO.:210; or (xvi) an immunoglobulin heavy chain fused to a scFv at its C-terminus comprising the amino acid sequence of SEQ ID NO.:214, and a light chain comprising the amino acid sequence of SEQ ID NO.:215; or (xvii) an immunoglobulin heavy chain fused to a scFv at its C-terminus comprising the amino acid sequence of SEQ ID NO.:219, and a light chain comprising the amino acid sequence of SEQ ID NO.:221; or (xviii) an immunoglobulin heavy chain fused to a scFv at its C-terminus comprising the amino acid sequence of SEQ ID NO.:224; and a light chain comprising the amino acid sequence of SEQ ID NO.:225; or (xix) an immunoglobulin heavy chain fused to a scFv at its C-terminus comprising the amino acid sequence of SEQ ID NO.:229; and a light chain comprising the amino acid sequence of SEQ ID NO.:230; or (xx) an immunoglobulin heavy chain fused to a scFv at its C-terminus comprising the amino acid sequence of SEQ ID NO.:234; and a light chain comprising the amino acid sequence of SEQ ID NO.:235; or (xvii) an immunoglobulin heavy chain fused to a scFv at its C-terminus comprising the amino acid sequence of SEQ ID NO.:239; and a light chain comprising the amino acid sequence of SEQ ID NO.:240; or (xviii) an immunoglobulin heavy chain fused to a scFv at its C-terminus comprising the amino acid sequence of SEQ ID NO.:244; and a light chain comprising the amino acid sequence of SEQ ID NO.:245; or (xix) an immunoglobulin heavy chain fused to a scFv at its C-terminus comprising the amino acid sequence of SEQ ID NO.:249; and a light chain comprising the amino acid sequence of SEQ ID NO.:250; or (xx) an immunoglobulin heavy chain fused to a scFv at its C-terminus comprising the amino acid sequence of SEQ ID NO.:254; and a light chain comprising the amino acid sequence of SEQ ID NO.:255; or (xxi) an immunoglobulin heavy chain fused to a scFv at its C-terminus comprising the amino acid sequence of SEQ ID NO.:259; and a light chain comprising the amino acid sequence of SEQ ID NO.:260; or (xxii) an immunoglobulin heavy chain fused to a scFv at its C-terminus comprising the amino acid sequence of SEQ ID NO.:264; and a light chain comprising the amino acid sequence of SEQ ID NO.:265; or (xxiii) an immunoglobulin heavy chain fused to a scFv at its C-terminus comprising the amino acid sequence of SEQ ID NO.:269; and a light chain comprising the amino acid sequence of SEQ ID NO.:270; or (xxiv) an immunoglobulin heavy chain fused to a scFv at its C-terminus comprising the amino acid sequence of SEQ ID NO.:274; and a light chain comprising the amino acid sequence of SEQ ID NO.:275; or (xxv) (a) a first polypeptide comprising an immunoglobulin heavy chain fused to a scFv at its C-terminus comprising the amino acid sequence of SEQ ID NO.: 151, wherein the variable heavy chain portion specifically binding to CD137 differs in amino acid sequence from the CDRH1 SEQ ID NO.:672 by an amino acid substitution of not more than one amino acid wherein X1 is selected from the group consisting of A or S, and/or which differs from the CDRH2 SEQ ID NO.:335 by an amino acid substitution of not more than four amino acids wherein X1 is selected from the group consisting of N or Q, X2 is selected from the group consisting of D or E, X3 is selected from the group consisting of G or A, and X4 is selected from the group consisting of T or K, X5 is selected from the group consisting of L or V, X6 is selected from the group consisting of D or E, X7 is selected from the group consisting of L or V, and X8 is selected from the group consisting of S or G, wherein said scFv is a FAP binding scFv comprises a heavy chain domain (VH) and a light chain domain, wherein said FAP VH differs in amino acid sequence from the CDRH2 SEQ ID NO.:341 by an amino acid substitution of not more than one amino acid wherein X1 is selected from D or E, and said FAP VL differs in amino acid sequence from the CDRL1 SEQ ID NO.:691 by an amino acid substitution of not more than two amino acids wherein X1 is selected from the group consisting of N, R, or S, and X2 is selected from is selected from N or S, and (b) a second polypeptide comprising a light chain domain (VL) which specifically binds to CD137 comprising the amino acid sequence of SEQ ID NO.:152; which differs in amino sequence from the CDRL1 SEQ ID NO.:336 by an amino acid substitution of not more than four amino acids wherein X1 is selected from the group consisting of K or R, X2 is selected from the group consisting of D or S, X3 is selected from the group consisting of V or I, X4 is selected from the group consisting of S or T, and X5 is selected from the group consisting of V and L, and/or which differs in amino acid sequence from the CDRL2 SEQ ID NO.:337 by an amino acid substitution of not more than five amino acids wherein X1 is selected from the group consisting of S or A, X2 is selected from the group consisting of Y or S, X3 is selected from the group consisting of R or L, X4 is selected from the group consisting of Y and Q, and X5 is selected from the group consisting of S or T; or (xxvi) (a) a first polypeptide comprising an immunoglobulin heavy chain fused to a scFv at its C-terminus comprising the amino acid sequence of SEQ ID NO.:155, wherein the variable heavy chain portion specifically binding to CD137 differs in amino acid sequence from the CDRH1 SEQ ID NO.:672 by an amino acid substitution of not more than one amino acid wherein X1 is selected from the group consisting of A or S, and/or which differs from the CDRH2 SEQ ID NO.:335 by an amino acid substitution of not more than four amino acids wherein X1 is selected from the group consisting of N or Q, X2 is selected from the group consisting of D or E, X3 is selected from the group consisting of G or A, and X4 is selected from the group consisting of T or K, X5 is selected from the group consisting of L or V, X6 is selected from the group consisting of D or E, X7 is selected from the group consisting of L or V, and X8 is selected from the group consisting of S or G, and wherein said scFv is a FAP binding scFv comprising a heavy chain domain (VH) and a light chain domain (VL), wherein said FAP VH differs in amino acid sequence from the CDRH1 SEQ ID NO.:694 by an amino acid substitution of not more than one amino acids wherein X1 is selected from the group consisting of S or N, and/or which differs in amino acid sequence from the CDRH2 SEQ ID NO.:342 by an amino acid substitution of not more than one amino acids wherein X1 selected from the group consisting of D or E, and/or which differs in amino acid sequence from the CDRH3 SEQ ID NO.:343 by an amino acid substitution of not more than one amino acids wherein X1 is selected from the group consisting of N or E; and (b) a second polypeptide comprising a light chain which specifically binds to CD137 comprising the amino acid sequence of SEQ ID NO.:156; which differs in amino sequence from the CDRL1 SEQ ID NO.:336 by an amino acid substitution of not more than four amino acids wherein X1 is selected from the group consisting of K or R, X2 is selected from the group consisting of D or S, X3 is selected from the group consisting of V or I, X4 is selected from the group consisting of S or T, and X5 is selected from the group consisting of V and L, and/or which differs in amino acid sequence from the CDRL2 SEQ ID NO.:337 by an amino acid substitution of not more than five amino acids wherein X1 is selected from the group consisting of S or A, X2 is selected from the group consisting of S or Y, X3 is selected from the group consisting of S or Y, and, X4 is selected from the group consisting of Y or Q, and X5 is selected from the group consisting of S or T; or (xxvii) (a) a first polypeptide comprising an immunoglobulin heavy chain fused to a scFv at its C-terminus comprising the amino acid sequence of SEQ ID NO.:153, wherein the variable heavy chain portion specifically binding to CD137 differs in amino acid sequence from the CDRH2 SEQ ID NO.:338 by an amino acid substitution of not more than one amino acids wherein X1 is selected from the group consisting of Y or I, and wherein said scFV is a FAP binding scFv comprising a heavy chain domain (VH) and a light chain domain, wherein said FAP VH differs in amino acid sequence from the CDRH2 SEQ ID NO.:341 by an amino acid substitution of not more than one amino acid wherein X1 is selected from D or E, and said FAP VL differs in amino acid sequence from the CDRL1 SEQ ID NO.:691 by an amino acid substitution of not more than two amino acids wherein X1 is selected from the group consisting of N, R, or S, and X2 is selected from is selected from N or S, and (b) a second polypeptide comprising a light chain which specifically binds to CD137 comprising the amino acid sequence of SEQ ID NO.:154; which differs in amino acid sequence from the CDRL1 SEQ ID NO:669 by an amino acid substitution of not more than one amino acid wherein X1 is selected from the group consisting of N or Q, and/or from the CDRL2 SEQ ID NO.:339 by an amino acid substitution of not more than one amino acids wherein X1 is selected from the group consisting of L or G; or (xxviii) (a) a first polypeptide comprising an immunoglobulin heavy chain fused to a scFv at its C-terminus comprising the amino acid sequence of SEQ ID NO.:153, wherein the variable heavy chain portion specifically binding to CD137 differs in amino acid sequence from the CDRH2 SEQ ID NO.:338 by an amino acid substitution of not more than one amino acids wherein X1 is selected from the group consisting of Y or I, and wherein said a scFv is a FAP binding scFv comprising a heavy chain domain (VH) and a light chain domain (VL), wherein said FAP VH differs in amino acid sequence from the CDRH2 SEQ ID NO.:341 by an amino acid substitution of not more than one amino acids wherein X1 selected from the group consisting of D or E, and said FAP VL differs in amino acid sequence from the CDRL1 SEQ ID NO.:691 by an amino acid substitution of not more than two amino acids wherein X1 is selected from the group consisting of N, R, or S, and X2 is selected from is selected from N or S; and (b) a second polypeptide comprising a light chain which specifically binds to CD137 comprising the amino acid sequence of SEQ ID NO.:154; which differs in amino acid sequence from the CDRL1 SEQ ID NO.:669 by an amino acid substitution of not more than one amino acid wherein X1 is selected from the group consisting of N or Q, and/or the CDRL2 SEQ ID NO.:339 by an amino acid substitution of not more than one amino acids wherein X1 is selected from the group consisting of L or G.

Thus, in a further aspect, the invention provides a bispecific antigen binding molecule, wherein
(i) each of the polypeptides capable of specific binding to CD137 comprise
  (a) a heavy chain variable region VH comprising an amino acid sequence that is at least about 95%, 96%, 97%, 98%, 99%, or 100% identical to the amino acid sequence select from the group consisting of SEQ ID NO.:10, SEQ ID NO.:20, SEQ ID NO.:30, SEQ ID NO.:40, SEQ ID NO.:50, and SEQ ID NO.:60 and a light chain variable region VL comprising an amino acid sequence that is at least about 95%, 96%, 97%, 98%, 99%, or 100% identical to the amino acid sequence select from the group consisting of SEQ ID NO.:15, SEQ ID NO.:25, SEQ ID NO.:35, SEQ ID NO.:45, SEQ ID NO.:55, SEQ ID NO.:65; or
  (b) a variable heavy chain region VH comprising an amino acid sequence that is at least about 95%, 96%, 97%, 98%, 99%, or 100% identical to the amino acid sequence select from the group consisting of SEQ ID NO.:70, SEQ ID NO.:80, SEQ ID NO.:90, and SEQ ID NO.:100, and a light chain variable region VL comprising an amino acid sequence that is at least about 95%, 96%, 97%, 98%, 99%, or 100% identical to the amino acid sequence select from the group consisting of SEQ ID NO.:75, SEQ ID NO.:85, SEQ ID NO.:95, and SEQ ID NO.:105; and
(ii) each of the polypeptides capable of specific binding to FAP comprise
  (a) a variable heavy chain region VH comprising an amino acid sequence that is at least about 95%, 96%, 97%, 98%, 99%, or 100% identical to the amino acid sequence select from the group consisting of SEQ ID NO.:106, SEQ ID NO.:115, and SEQ ID NO.:124, and a light chain variable region VL comprising an amino acid sequence that is at least about 95%, 96%, 97%, 98%, 99%, or 100% identical to the amino acid sequence select from the group consisting of SEQ ID NO.:110, SEQ ID NO.:119, and SEQ ID NO.:128; or
  (b) a variable heavy chain region VH comprising an amino acid sequence that is at least about 95%, 96%, 97%, 98%, 99%, or 100% identical to the amino acid sequence select from the group consisting of SEQ ID NO.:133 and SEQ ID NO.:142, and a light chain variable region VL comprising an amino acid sequence that is at least about 95%, 96%, 97%, 98%, 99%, or 100% identical to the amino acid sequence select from the group consisting of SEQ ID NO.:137 and SEQ ID NO.:146.

A further aspect of the invention provides a nucleic acid molecule or nucleic acid molecules encoding an immunoglobulin-like binding molecule of the invention or an expression vector or expression vectors containing such a nucleic acid molecule. The term "vector" or "expression vector" is synonymous with "expression construct" and refers to a DNA molecule that is used to introduce and direct the expression of a specific gene to which it is operably associated in a target cell. The term includes the vector as a self-replicating nucleic acid structure as well as the vector incorporated into the genome of a host cell into which it has been introduced. The expression vector of the present invention comprises an expression cassette. The term "expression cassette" refers to a polynucleotide generated recombinantly or synthetically, with a series of specified nucleic acid elements that permit transcription of a particular nucleic acid in a target cell. The recombinant expression cassette can be incorporated into a plasmid, chromosome, mitochondrial DNA, plastid DNA, virus, or nucleic acid fragment. Typically, the recombinant expression cassette portion of an expression vector includes, among other sequences, a nucleic acid sequence to be transcribed and a promoter. In certain embodiments, the expression cassette of the invention comprises polynucleotide sequences that encode bispecific antigen binding molecules of the invention or fragments thereof; typically multiple expression vectors encoding different portions (e.g., heavy chain and light chains are encoded in different expression vectors) of the immunoglobulin-like binding molecule of the invention are transfected into the same host cell at the same time. Expression vectors allow transcription of large amounts of stable mRNA. Once the expression vector is inside the target cell, the ribonucleic acid molecule or protein that is encoded by the gene is produced by the cellular transcription and/or translation machinery. In one embodiment, the expression vector or vectors of the invention comprises an expression cassette or cassettes that comprises polynucleotide sequences that encode bispecific antigen binding molecules of the invention or fragments thereof.

A further aspect of the invention provides a host cell containing a nucleic acid molecule of the invention in functional association with an expression control sequence. The terms "host cell", "host cell line," and "host cell culture" are used interchangeably and refer to cells into which exogenous nucleic acid has been introduced, including the progeny of such cells. Host cells include "transformants" and "transformed cells," which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein. A host cell is any type of cellular system that can be used to generate the bispecific antigen binding molecules of the present invention. Host cells include cultured cells, e.g. mammalian cultured cells, such as CHO cells, or hybridoma cells, yeast cells, insect cells, and plant cells, to name only a few, but also cells comprised within a transgenic animal or animal tissue.

A further aspect of the invention provides a method of production of a binding molecule of the invention, as described herein before comprising the steps of
  (a) cultivating the host cell of the invention under conditions allowing expression of the molecule; and,
  (b) recovering the molecule.

A further aspect of the invention provides an immunoglobulin-like binding molecule of the invention, for use in medicine.

The term "cancer" as used herein refers to proliferative diseases, such as lymphomas, lymphocytic leukemias, lung cancer, non-small cell lung (NSCL) cancer, bronchioloalveolar cell lung cancer, bone cancer, pancreatic cancer, skin cancer, cancer of the head or neck, cutaneous or intraocular melanoma, uterine cancer, ovarian cancer, rectal cancer, cancer of the anal region, stomach cancer, gastric cancer, colon cancer, breast cancer, uterine cancer, carcinoma of the fallopian tubes, carcinoma of the endometrium, carcinoma of the cervix, carcinoma of the vagina, carcinoma of the vulva, Hodgkin's Disease, cancer of the esophagus, cancer of the small intestine, cancer of the endocrine system, cancer of the thyroid gland, cancer of the parathyroid gland, cancer of the adrenal gland, sarcoma of soft tissue, cancer of the urethra, cancer of the penis, prostate cancer, cancer of the bladder, cancer of the kidney or ureter, renal cell carcinoma, carcinoma of the renal pelvis, mesothelioma, hepatocellular cancer, biliary cancer, neoplasms of the central nervous system (CNS), spinal axis tumors, brain stem glioma, glioblastoma multiforme, astrocytomas, schwannomas, ependymomas, medulloblastomas, meningiomas, squamous cell carcinomas, pituitary adenoma and Ewings sarcoma, including refractory versions of any of the above cancers, or a combination of one or more of the above cancers. A further aspect of the invention provides an immunoglobulin-like binding molecule of the invention, for use in the therapy of cancer, preferably colorectal cancer (CRC) (e.g, colorectal adenocarcinoma), gastric cancer (GC) (e.g., gastric adenocarcinoma), pancreatic cancer (PAC) (e.g., pancreatic adenocarcinoma), and lung cancer (LC) (e.g., lung squamous cell carcinoma, lung adenocarcinoma).

A further aspect of the invention provides a pharmaceutical composition, comprising an immunoglobulin-like binding molecule according to any one of the embodiments of the invention together with a pharmaceutically acceptable carrier and optionally one or more further active ingredients, e.g. a chemotherapeutic agent, radiation and/or other agents for use in cancer immunotherapy.

In one aspect, provided is a bispecific, immunoglobulin-like binding molecule according to any one of the embodiments as described or a pharmaceutical composition comprising said immunoglobulin-like binding molecule of the invention, for use in stimulation of a T cell response; supporting survival and/or recruitment of activated T cells; preventing suppression and/or anergy of immune cells; treatment of infections, treatment of cancer; delaying the progression of cancer; and/or prolonging the survival of a patient suffering from cancer.

A further aspect of the invention provides a method of treatment of cancer comprising administering an effective amount of an immunoglobulin-like binding molecule of the invention to a patient in need thereof.

BRIEF DESCRIPTION OF THE FIGURES

FIG. 1A-B: A. Schematic representation of the Doppelmab immunoglobulin-like binding molecule of the invention. B. Schematic of the mode of action of CD137/FAP binding molecules in tumor stroma, where CD137 agonist activity would be restricted to microenvironments expressing FAP+ stromal cells.

FIG. 2A-B: A. Binding of anti-human CD137 antibodies to surface expressed cynomolgus CD137: Representative clones CD137 #B13, B17, B19, B20, B21, B27, B28, B30, and B31 expressed as mean fluorescent intensity over increasing Ab concentration (nM); B. Binding of anti-human CD137 antibodies to surface expressed human CD137 Representative clones CD137 #B13, B17, B19, B20, B21, B27, B28, B30, B31 expressed as mean fluorescent intensity over increasing Ab concentration (nM).

FIG. 3A-D: Cross-linking-dependent activity of CD137 molecules A. $EC_{50}$ Graph of Anti-CD137 Purified Chimeric IgG Agonistic Activation with (CL+) and without secondary antibody (CL-) crosslinking. Representative clones CD137 #A16, A17, A18, A19, A20, A21, A49, A51, A50, A53, A54, and A57. B. Bar graphs of Anti-CD137 Purified Chimeric IgG Agonistic Activation with (+) and without (−) secondary antibody. (C) Activity in the Jurkat NFκB assay measured as RLU demonstrating agonist activity only with secondary antibody cross-linking. Positive controls are Urelumab chimeric IgG1-KO, and Utomilumab as IgG1-KO. Representative anti-CD137 clones include #B2, B5, B7, B9, B10, B12, B13, B17, B19, B27, B30, B31, A1, A13, A2, A25, A3, A30, A39, A4, A47, B3, B4, B21, A12, A16, A17, A19, A26, A27, A41, A44, A45, A46, A49, A57, A8, A34, and A35. C. Activity in the Jurkat NFκB assay measured as RLU demonstrating agonist activity only without secondary antibody cross-linking.

FIG. 4A-B: A. A schematic diagram of 2D-assay in which bound CD137 Fab fragments are incubated in the presence of biotinylated huCD137 antigen, and the bound biotinylated antigen is detected with strep-avidin labeled flurochrome. B. ELISA titrations of graft Fab versus chimeric B21 Fab. Different graft preps were evaluated in ELISA binding and chimeric Fab demonstrated better binding compared to graft Fab. 2H11 a non-related Fab was kept as negative control.

FIG. 6A-B: A. Binding analysis of anti-CD137 candidates post mutational modification of Vk-CDRs. Each bar represents the location of an amino acid modification within the variable light chain. B. Binding analysis of anti-CD137 candidates post mutational modification of VH-CDRs. Each bar represents the location of an amino acid modification within the variable heavy chain and the corresponding OD.

FIG. 8A-B. A. Cross-linking-dependent activity of optimized anti-CD137 candidates post Vk and VH optimization. A and B: Agonistic Activation without (A) and with (B) secondary antibody crosslinking measured by NFkB-activity in Jurkat assay expressed as RLU. Representative clones CD137 B21.V1-V.40, and A49.V41-V.48 as compared to parental clones.

FIGS. 10A-B. Effect of CD137 binding molecules in interfering the activation of human CD137-Jurkat cells induced by CD137 Ligand-expressing cells. (A) Various CD137 binding molecules differentially impact the activation of Jurkat cells expressing human CD137 in presence of 293 cells expressing human CD137 Ligand. While BMSAB, PfizerAb and the Roche split-trimeric-4-1BBL (71-248)/

Figure 5:
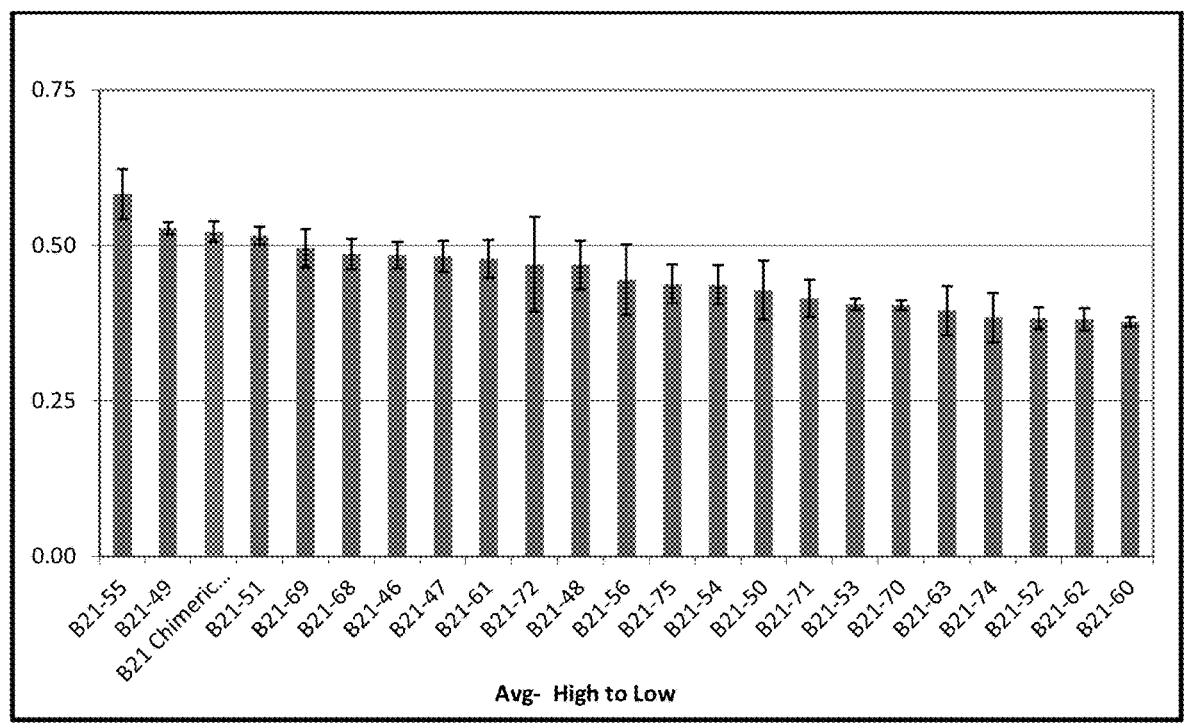
FIG. 5: ELISA of the top framework optimized Fabs of CD137 clones. Fabs identified on the basis of binding in ELISA assays were evaluated for binding with respect to chimeric CD137 B21 clone Fab. Binding analysis of Fabs to human CD137 for 22 candidate molecules from the VK/VH combination library are shown; including B21. V55, V49, V51, V69, V47, V61, V72, V48, V56, V75, V54, V50, V71, V53, V70, V63, V74, V52, V62, and V61, arranged in comparison to the parent B21 parent molecule.

FAP(28H1) molecule ("construct 2.11"; see WO2017/194438) interfere with the activation of Jurkat cells induced by CD137 Ligand, CD137 B21 Variant allows the binding of CD137 Ligand and a productive T cell activation induced by CD137 Ligand. (B) Broader dose titration of CD137 B21 variant and construct 2.11 molecule in the assay system described in (A). CD137 B21 Variant, when tested up to 100 nM, does not block the functional interaction between human CD137 and human CD137 Ligand.

FIG. 11A-C. A. Serum titers from different OminChicken® derived anti-human FAP antibodies demonstrating showing cross reactivity to human, mouse and cyno FAPas measured by Elisa. B. MFI of binding of anti-FAP antibodies to stable cell lines expressing human FAP (HT1080-FAP) as compared to wild type HT1080 wild type (WT) cells. Representative clones #D6, E11, G3, H12, H3, A9, C12, C3, C8, D2, E1, E11.2, and H9. C. MFI of binding of anti-FAP antibodies to stable cell lines expressing murine FAP (B16-FAP) as compared to wild type B16 wild-type cells. Representative clones #D6, E11, G3, H12, H3, A9, C12, C3, C8, D2, E1, E11.2, and H9.

FIG. 12A-C. The effect of the bispecific CD137 (4-1BB, TNFRSF9)/Fibroblast Activation Protein (FAP) molecules on cell activation. A. FAP+HT1080 cells and FAP-ve HT1080 cells were incubated for 24 hours with the CD137/FAP bispecific molecule; as compared to B. Urelumab, a monovalent CD137 (4-1BB, TNFRSF9) antibody alone; or C. Utomilumab, a monovalent CD137 (4-1BB, TNFRSF9) antibody alone.

FIG. 13A-D A. CD137 B21 variants co-cultured with HT1080-FAP expressing cells. NF-κB dependent induction of a luciferase reporter gene in Jurkat-CD137 cells when co-cultured with HT1080-FAP (A,C) or HT1080-wild type cells (B,D). Levels of reporter gene activity correlate to representative clone variants including: B21.V16 (CD137 #2)/FAP #5, B21.V22 (CD137 #3)/FAP #3, B21.V37 (CD137 #6)/FAP #3, B21.V16 (CD137 #2)/FAP #2, B21.V22 (CD137 #4)/FAP #3, B21.V25 (CD135 #5)/FAP #3, B21.V22 (CD137 #4)/FAP #2, B21.V25 (CD137 #5)/FAP #2, B21.V25 (CD137 #4)/FAP #5, B21.V22 (CD137 #3)/FAP #5, B21.V37 (CD137 #6)/FAP #2, B21.V29 (CD137 #5)/FAP #5, and B21.V37 (CD137 #6)/FAP #5. B. CD137 B21 variants as shown in (A) with HT1080-wild type cells. C. CD137 A49 variants co-cultured with HT1080-FAP expressing cells. Representative clone variants include: A49.V48 (CD137 #7)/FAP #3, A49.V47 (CD137 #9)/FAP #3, A49.V43 (CD137 #8)/FAP #3, A49.V48 (CD137 #7)/FAP #5, A49.V48 (CD137 #7)/FAP #2, A49.V47 (CD137 #9)/FAP #5, A49.V47 (CD135 #9)/FAP #2, A49.V43 (CD137 #8)/FAP #2, and A49.V43 (CD137 #8)/FAP #5. D. CD137 A49 variants as shown in (C) with HT1080-wild type cells.

FIG. 14A-H. IFN-γ production in presence of PBMC, CD137/FAP variants: A. Anti-CD3 stimulated PBMCs co-cultured with FAP expressing HT1080 cells produce increased IFN-γ via CD137 co-stimulation. Representative clone variants include B21.V16 (CD137 #2)/FAP #5, B21.V16 (CD137 #2)/FAP #2, B21.V16 (CD137 #2)/FAP #3; B. Representative clone variants include B21.V22 (CD137 #3)/FAP #5, B21.V22 CD137 #3/FAP #2, B21.V22 (CD137 #3)/FAP #3; C. Representative clone variants include B21.V25 (CD137 #4)/FAP #5, B21.V22 (CD137 #4)/FAP #2, B21.V22 (CD137 #4)/FAP #3; D. Representative variants B21.V29 (CD137 #5)/FAP #5, B21.V25 (CD137 #5)/FAP #2, B21.V25 (CD135 #5)/FAP #3; E. Representative variants B21.V37 (CD137 #6)/FAP #5, B21.V37 (CD137 #6)/FAP #2, B21.V37 (CD137 #6)/FAP #3; F. Representative variants A49.V43 (CD137 #8)/FAP #5, A49.V43 (CD137 #8)/FAP #2, A49.V43 (CD137 #8)/FAP #3; G. Representative variants A49.V47 (CD137 #9)/FAP #5, A49.V47 (CD135 #9)/FAP #2, A49.V47 (CD137 #9)/FAP #3; H. Representative variants A49.V48 (CD137 #7)/FAP #5, A49.V48 (CD137 #7)/FAP #2, A49.V48 (CD137 #7)/FAP #3.

FIG. 15A-B. IFN-γ secretion of individual donor PBMCs incubated with increasing concentrations of an exemplary CD137 B21/FAP bispecific molecule in the presence of HT1080 wild type (A) or HT1080-FAP expressing cells (B).

FIG. 16A-B. A. FAP Enzyme Assay: Exemplary molecules of the invention, CD137-B21/FAP-C3 and murine CD137 B21/FAP-A11, do not interfere with the enzymatic activity of the FAP protein. B. Talabostat mesylate inhibition assay: Positive control for FAP inhibition.

Figure 17:
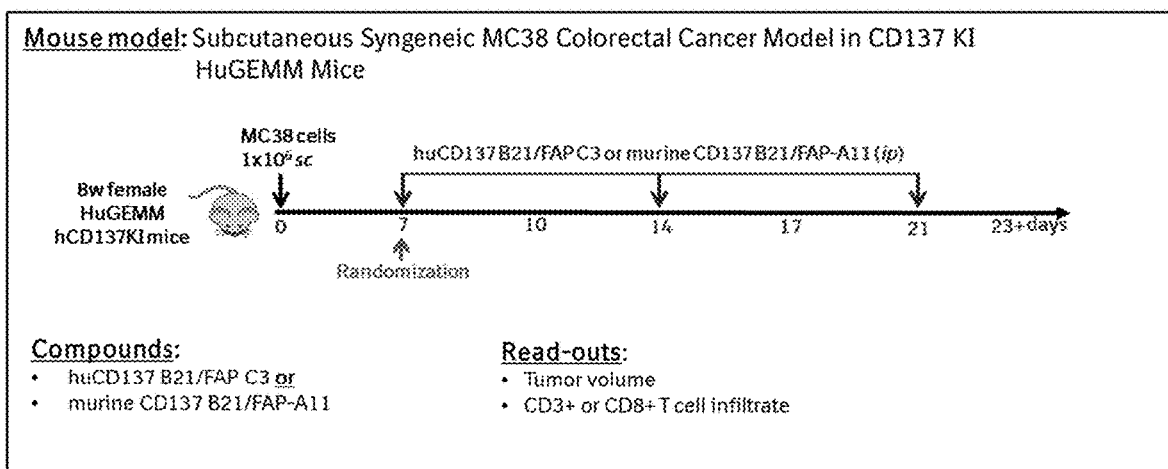

FIG. 17. Schematic representation of dosing schedule of the molecules in the subcutaneous syngeneic MC38 colorectal cancer model in CD137 KI HuGEMM™ mice.

FIG. 18A-D. In vivo efficacy of human CD137 B21/FAP C3 and murine CD137 B21/FAP-A11 montherapy in subcutaneous syngeneic MC38 colorectal cancer model in CD137 KI HuGEMM mice. (A) Average tumor growth curve post-treatment with human CD137 B21/FAP C3; (B) Individual tumor growth curve post-treatment with human CD137 B21/FAP C3; (C) Average tumor growth curve post-treatment with murine CD137 B21/FAP A11; and (D) Individual tumor growth curve post-treatment with murine CD137 B21/FAP A11.

FIG. 19A-B. Recruitment of TILs by CD137/FAP molecules: Human CD137 B21/FAP C3 and murine CD137 B21/FAP-A11 binding molecules of the invention are able to induce increases of CD3+(A) or CD8+(B) T cell infiltrates into the tumor microenvironment when compared with the control group.

FIG. 20A-E. Combination treatment PD-1 and CD137/FAP A. Schematic representation of mouse model and dosing schedule of CD137/FAP and PD-1. B. Binding molecules of the invention are able to induce reductions of the tumor volume in combination with a PD-1 antagonist mAb when compared with the control group and the effect is dose dependent. (B), (D) show the combination therapy with mouse PD-1 antibody and human CD137 B21/FAP C3; or (C), (E) show the combination therapy with the mouse PD-1 and murine CD137 B21/FAP A11. Both led to a strong and statistically significant (p<0.0001) inhibition of tumor growth as demonstrated by a decrease in tumor volume.

FIG. 21A-G. Binding molecules of the invention are able to induce both CD4 and CD8 T cell infiltration when combined with a PD-1 agonist as compared with the control groups. (A) Viable tumor area measured post-treatment with vehicle alone, anti-PD-1 alone, huCD137 B21/FAP-C3 alone, or huCD137 B21/FAP-C3+PD-1 combination. (B) CD4+ cell density measured in the tumor viable area post-treatment with vehicle alone, anti-PD-1 alone, huCD137 B21/FAP-C3 alone, or huCD137 B21/FAP-C3+PD-1 combination. (C) CD8+ cell density measured in the tumor viable area post-treatment with vehicle alone, anti-PD-1 alone, huCD137 B21/FAP-C3 alone, or huCD137 B21/FAP-C3+PD-1 combination. (D) Tumor viable area is plotted as a function of CD8+ T cell density with treatment with vehicle alone. (E) Tumor viable area is plotted as a function of CD8+ T cell density with treatment with anti-PD-1 alone. (F) Tumor viable area is plotted as a function of CD8+ T cell density with treatment with huCD137-B21/FAP-C3 alone. (G) Tumor viable area plotted as a function of CD8+ T cell density with treatment with huCD137-B21/FAP-C3 in combination with anti-PD-1. The data also demonstrates that the increase in CD8+ T cell infiltration is positively correlated with loss of tumor viable area.

FIG. 22: Point mutations made in VL.
FIG. 23: CDRS in VL variants.
FIG. 24: Point mutations made in VH.
FIG. 25: CDRS in VH variants.

DETAILED DESCRIPTION OF THE INVENTION

CD137 is widely expressed throughout the hematopoietic and non-hematopoetic compartments: activated T-cells, T regulatory cells, NK cells, dendritic cells, activated monocytes, neutrophils, eosinophils, mast-cells, activated B cells, Reed Sternberg cells and blood vessel walls (on the endothelial layer and vascular smooth muscle cells), etc. As shown in preclinical studies, severe hepatotoxicity including death has been reported in the clinical trials of Urelumab, a potent monospecific CD137 agonistic antibody. Both high CD137 affinity and hyperclustering via FcγR on liver-resident T-cells is thought to contribute to Urelumab-mediated hepatotoxicity.

The CD137/FAP molecules of the invention are engineered to have lower CD137 binding affinity, a LALA mutation for reduced FcγR binding and the requirement of simultaneous binding to CD137 and tumor-stroma specific FAP for activity. The FAP (Fibroblast activation protein) is an anchor target. FAP is only expressed on activated fibroblast cells which are located within the tumour stroma. Hence a FAP bispecific molecule will only function to promote T cell activation and killing of cancer cells which are in close physical contact with an activated fibroblast. Tumor cells that are not in direct contact with an activated fibroblast will not be affected by this treatment and will continue to proliferate. Hence there are clear advantages with using FAP as an anchor target to mediate CD137 receptor-induced activation and T cell infiltration only at the tumor site.

Inventors have found co-localized expression of CD137 and FAP in tumors. Inventors investigate prevalence of co-localized expression in a large subset of colorectal cancer (CRC), gastric cancer (GC), and pancreatic cancer (PAC). A high prevalence was shown consistently for the expression of CD137 (88-100%) as well as for FAP (87-100%) in CRC. In GC, CD137 was also demonstrated in 56-90% of all cases, with significantly higher frequency in intestinal types compared to diffuse types, while FAP has been shown to be constitutively expressed at high levels in primary and metastatic gastric carcinomas. In PAC, CD137 expression could be shown in 50-82% of all cases and FAP in 81%.

Therefore, CD137 and FAP show co-localized expression in a variety of tumors, with little or no co-expression in non-cancerous cells. Notably, FAP was not detectable in normal liver tissue or hepatocytes with reported sensitivity to CD137 activation.

Terms not specifically defined herein should be given the meanings that would be given to them by one of skill in the art in light of the disclosure and the context. As used in the specification, however, unless specified to the contrary, the following terms have the meaning indicated and the following conventions are adhered to.

The first aspect of the invention provides an immunoglobulin-like binding molecule having at least one antigen binding site that binds specifically to CD137 (4-1BB, TNFRSF9) wherein the antigen binding site that binds specifically to CD137 (4-1BB Ligand Receptor) is part of an immunoglobulin (Ig) molecule and at least one antigen binding site that binds specifically to Fibroblast activation protein (FAP) wherein the antigen binding site that bind specifically to Fibroblast Activation Protein (FAP) comprises a scFv. Each protein and their associated genes are known in the art and are well represented in biological databases.

"Human CD137 (4-1BB, TNFRSF9)" is defined as the protein provided in NCBI: NP_001552 and Uniprot: Q07011, (SEQ ID NO. 1) and the nucleic acid sequence encoding that protein. The amino acids defining the various CRD regions of the extracellular domain (ECD) are as defined in Table 1 below. The amino acid sequence of the human —Fc-His protein tagged for human CD137 and cyno CD137 used as the immunogens in the immunization campaign are included in Table 1 corresponding to SEQ ID NOs: 335 and 343. "Cynomolgus CD137 (4-1BB, TNFRSF9)" is defined as the protein provided in Uniprot accession no. F6W5G6 (SEQ ID NO.: 2) and the nucleic acid sequence encoding that protein. "Murine CD137 (4-1BB, TNFRSF9)" is defined as the protein provided in Uniprot accession P20334 (SEQ ID NO.:3) and the nucleic acid sequence encoding that protein.

TABLE 1

ANTIGEN SEQUENCES

| | | | |
|---|---|---|---|
| SEQ ID NO.: 1 | HUMAN 4-1BB (CD 137) | LQDPCSNCPAGTFCDNNRNQI CSPCPPNSFSSAGGQRTCDIC RQCKGVFRTRKECSTSNAECD CTPGFHCLGAGCSMCEQDCKQ GQELTKKGCKDCCFGTFNDQK RGICRPWTNCSLDGKSVLVNG TKERDVVCGPSPADLSPGASS VTPPAPAREPGHSPQ | UniProt: Q07011 |
| SEQ ID NO.: 349 | HUMAN 4-1BB (CD 137) Human-Fc-His protein | LQDPCSNCPAGTFCDNNRNQI CSPCPPNSFSSAGGQRTCDIC RQCKGVFRTRKECSSTSNAEC DCTPGFHCLGAGCSMCEQDCK QGQELTKKGCKDCCFGTFNDQ KRGICRPWTNCSLDGKSVLVN GTKERDWCGPSPADLSPGASS VTPPAPAREPGHSPQENLYFQ GGGSGGSGGSGGSGGSGGSGG EPKSCDKTHTCPPCPAPEAAG GPSVFLFPPKPKDTLMISRTP EVTCVVVDVSHEDPEVKFNWY VDGVEVHNAKTKPREEQYNST YRVVSVLTVLHQDWLNGKEYK CKVSNKALPAPIEKTISKAKG QPREPQVYTLPPSRDELTKNQ VSLTCLVKGFYPSDIAVEWES NGQPENNYKTTPPVLDSDGSF FLYSKLTVDKSRWQQGNVFSC SVMHEALHNHYTQKSLSLSPG KAGSGHHHHHH | Used for immunization |
| SEQ ID NO.: 350 | HUMAN 4-1BB CRD1 | LQDPCSNCPAGTFCDNNRNQ IC | Amino acids 24-45 |
| SEQ ID NO.: 351 | HUMAN 4-1BB CRD2 | SPCPPNSFSSAGGQRTCDIC RQCKGVFRTRKECSSTSNAE C | Amino acids 46-86 |
| SEQ ID NO.: 352 | HUMAN 4-1BB CRD3 | DCTPGFHCLGAGCSMCEQDC KQGQELTKKGCK | Amino acids 87-118 |
| SEQ ID NO.: 353 | HUMAN 4-1BB CRD 4 | DCCFGTFNDQKRGICRPWTN CSLDGKSVLVNGTKERDVVC G | Amino acids 119-159 |

TABLE 1-continued

ANTIGEN SEQUENCES

| SEQ ID NO. | Name | Sequence | Notes |
|---|---|---|---|
| SEQ ID NO.: 354 | HUMAN 4-1BB CRD 1-3 | LQDPCSNCPAGTFCDNNRNQICSPCPPNSFSSAGGQRTCDICRQCKGVFRTRKECSSTSNAECDCTPGFHCLGAGCSMCEQDCKQGQELTKKKGCK | Amino acids 24-118 |
| SEQ ID NO.: 355 | HUMAN 4-1BB CRD 1-2 | LQDPCSNCPAGTFCDNNRNQICSPCPPNSFSSAGGQRTCDICRQCKGVFRTRKECSSTSNAEC | Amino acids 24-86 |
| SEQ ID NO.: 356 | HUMAN 4-1BB CRD 2-3 | SPCPPNSFSSAGGQRTCDICRQCKGVFRTRKECSSTSNAECDCTPGFHCLGAGCSMCEQDCKQGQELTKKKGC | Amino acids 46-118 |
| SEQ ID NO.: 357 | HUMAN 4-1BB CRD 3-4 | DCTPGFHCLGAGCSMCEQDCKQGQELTKKGCKDCCFGIFNDQKRGICRPWTNCSLDGKSVLVNGTKERDVVCG | Amino acids 88-159 |
| SEQ ID NO.: 358 | HUMAN 4-1BB CRD2/CRD3/CRD4 | SPCPPNSFSSAGGQRTCDICRQCKGVFRTRKECSSTSNAECDCIPGFHCLGAGCSMCEQDCKQGQELTKKGCKDCCFGTFNDQKRGICRPWTNCSIDGKSVLVNGTKERDVVCG | Amino acids 46-159 |
| SEQ ID NO.: 2 | CYNOMOLGUS 4-1BB | LQDLCSN CPAGTFCDNN RSQICSPCPP NSFSSAGGQR TCDICRQCKG VFKTRKECSS TSNAECDCIS GYHCLGAECS MCEQDCKQGQ ELTKKGCKDC CFGTFNDQKR GICRPWTNCS LDGKSVLVNG TKERDVVCGP SPADLSPGAS SATPPAPARE PGHSPQ | Uniprot: F6W5G6 |
| SEQ ID NO.: 359 | CYNO 4-1BB Fc-His protein | QDLCSNCPAGTFCDNNRSQICSPCPPNSFSSAGGQRTCDICRQCKGVFKTRKECSSTSNAECDCISGYHCLGAECSMCEQDCKQGQELTKKGCKDCCFGTFNDQKRGICRPWTNCSLDGKSVLVNGTKERDVVCGPSPADLSPGASSATPPAPAREPGHSPQENLYFQGGGSGGSGGSGGSGGSGGEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWENGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKAGSGHHHHHH | Used for immunization |
| SEQ ID NO.: 3 | MURINE 4-1BB | VQNSCDNCQPGTFCRKYNPVCKSCPPSTFSSIGGQPNCNICRVCAGYFRFKKFCSSTHNAECECIEGFHCLGPQCTRCEKDCRPGQELTKGCKTCSLGTFNDQNGTGVCRPWTNCSLDGRSVLKTGTTEKDVVCGPPVVSFSPSTTISVTPEGGPGGHSLQVL | Uniprot: P20334 |
| SEQ ID NO.: 360 | MURINE 4-1BB CRD1 | LQDPCDNCQPGTFCRKYNPVC | |
| SEQ ID NO.: 361 | MURINE 4-1BB CRD2 | SPCPPSTFSSIGGQPNCNICRVCAGYFRFKKFCSSIHNAEC | |
| SEQ ID NO.: 362 | MURINE 4-1BB CRD3 | DCIEGFHCLGPQCTRCEKDCRPGQELTKQGCK | |
| SEQ ID NO.: 363 | MURINE 4-1BB CRD4 | DCSLGTFNDQNGTGVCRPWFNCSLDGRSVLKTGTTEKDVVCG | |
| SEQ ID NO.: 4 | HUMAN FAP | MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD | NCBI: NP_004451 and Uniprot: Q12884 |
| SEQ ID NO.: 5 | MURINE FAP | MKTWLKTVFGVTTLAALALVVICIVLRPSRGNFKRALTLKDILNGTFSYKTYFPNWISEQEYLHQSEDDNIVFYNIETRESYIILSNSTMKSVNATDYGLSPDRQFVYLESDYSKLWRYSYTATYYIYDLQNGEFVRGYELPRPIQYLCWSPVGSKLAYVYQNNIYLKQRPGDPPFQITYTGRENRIFNGIPDWVYEEEMLATKYALWWSPDGKFLAYVEFNDSDIPIIAYSYYGDGQYPRTINIPYPKAGAKNPVVRVFIVDTTYPHHVGPMEVPVPEMIASSDYYFSWLTWVSSERVCLQWLKRVQNVSVLSICDFREDWHAWECPKNQEHVEESRTGWAGGFFVSTPAFSQDATSYYKIFSDKDGYKHIHYIKDTVENAIQITSGKWEAIYIFRVTQDSLFYSSNEFEGYPGRRNIYRISIGNSPPSKKCVTCHLRKERCQYYTASFSYKAKY | NCBI: NP_032012.1 and UniProt: P97321 |

TABLE 1-continued

ANTIGEN SEQUENCES

```
YALVCYGPGLPISTLHDGR
TDQEIQVLEENKELENSLR
NIQLPKVEIKKLKDGGLTF
WYKMILPPQFDRSKKYPLL
IQVYGGPCSQSVKSVFAVN
WITYLASKEGIVIALVDGR
GTAFQGDKFLHAVYRKLGV
YEVEDQLTAVRKFIEMGFI
DEERIAIWGWSYGGYVSSL
ALASGTGLFKCGIAVAPVS
SWEYYASIYSERFMGLPTK
DDNLEHYKNSTVMARAEYF
RNVDYLLIHGTADDNVHFQ
NSAQIAKALVNAQVDFQAM
WYSDQNHGISSGRSQNHLY
THMTHFLKQCFSLSD
```

"Human Fibroblast Activation Protein (FAP)" is defined as the protein provided in NCBI: NP_004451 and Uniprot: Q12884 (SEQ ID NO.:4), and the nucleic acid sequence encoding that protein. The term "Fibroblast activation protein (FAP)", is also known as Prolyl endopeptidase FAP or Seprase (EC 3.4.21). In one embodiment, the antigen binding molecule of the invention is capable of specific binding to human, mouse and/or cynomolgus FAP. The extracellular domain (ECD) of human FAP extends from amino acid position 26 to 760. The amino acid sequence of mouse FAP is shown in UniProt accession no. P97321 (SEQ ID NO.:4), or NCBI RefSeq NP_032012.1. The extracellular domain (ECD) of mouse FAP extends from amino acid position 26 to 761. Preferably, an anti-FAP binding molecule of the invention binds to the extracellular domain of FAP.

The present invention relates to binding molecules that have binding specificities for at least two different sites. In relation to the present invention, the immunoglobulin-like binding molecules are derived from antibodies. Techniques for making binding molecules include, but are not limited to, recombinant co-expression of two immunoglobulin heavy chain-light chain pairs having different specificities (see Milstein and Cuello, Nature 305: 537 (1983)), WO 93/08829, and Traunecker et al., EMBO J. 10: 3655 (1991)), and "knob-in-hole" engineering (see, e.g., U.S. Pat. No. 5,731,168). Immunoglobulin-like binding molecules of the invention may also be made by engineering electrostatic steering effects for making antibody Fc-heterodimeric molecules (WO 2009/089004A1); cross-linking two or more antibodies or fragments (see, e.g., U.S. Pat. No. 4,676,980, and Brennan et al., Science, 229: 81 (1985)); using leucine zippers to produce hi-specific antibodies (see, e.g., Kostelny et al., Immunol., 148(5): 1547-1553 (1992)); using "diabody" technology for making bispecific antibody fragments (see, e.g., Hollinger et al., PNAS. USA, 90:6444-6448 (1993)); and using single-chain Fv (sFv) dimers (see, e.g. Gruber et al., J. Immunol., 152:5368 (1994)); and preparing trispecific antibodies as described, e.g., in Tutt et al. J. Immunol. 147: 60 (1991).

As used herein the term "antigen binding site" comprises a heavy chain variable domain (V H) and a light chain variable domain (VL) derived from an antibody. The term "variable region" or "variable domain" refers to the domain of an antibody heavy or light chain that is involved in binding the antigen binding molecule to antigen. The variable domains of the heavy chain and light chain (VH and VL respectively) of a native antibody generally have similar structures, with each domain comprising four conserved framework regions (FRs) and three hypervariable regions. In such case, each variable domain of VH and VL comprises three complementary determining regions (CDRs) which make up the hypervariable regions or loops. Generally, native four-chain antibodies comprise six hypervariable regions, three in VH (H1, H2, H3) and three in VL (L1, L2, L3). A single VH or VL domain may be sufficient to confer antigen-binding specificity. In one aspect, an antigen-binding site according to the present invention or certain portions of the protein is generally derived from an antibody. The generalized structure of antibodies or immunoglobulin molecules is well known to those of skill in the art.

The term "antigen binding molecule" or "antigen binding polypeptide" refers in its broadest sense to a molecule that specifically binds an antigenic determinant Examples of antigen binding molecules or polypeptides are antibodies and antibody fragments.

"Antibodies" or "immunoglobulin molecules" (also known as immunoglobulins, abbreviated Ig) are gamma globulin proteins that can be found in blood or other bodily fluids of vertebrates, and are used by the immune system to identify and neutralize foreign objects, such as bacteria and viruses. They are typically made of basic structural units—each with two large heavy chains and two small light chains—to form, for example, monomers with one unit, dimers with two units or pentamers with five units. Antibodies can bind, by non-covalent interaction, to other molecules or structures known as antigens. This binding is specific in the sense that an antibody will only bind to a specific structure with high affinity. The unique part of the antigen recognized by an antibody is called an epitope, or antigenic determinant. The part of the antibody binding to the epitope is sometimes called paratope and resides in the so-called variable domain, or variable region (Fv) of the antibody. The variable domain comprises three so-called complementary-determining region (CDRs) spaced apart by framework regions (FRs). "Immunoglobulin-like binding molecules" have similar antigen binding features to immunoglobulin molecules and use the same functional strategy of an antibody molecule, i.e. they are capable of specifically binding to an antigen and has at least one antigen binding region. However, immunoglobulin-like molecules are not confined to those structures and sequences found in nature.

The term "bispecific" means that the antigen-binding molecule is able to specifically bind to at least two distinct antigenic determinants. The term "valent" refers to the presence of a specified number of biding sites specific for one distinct antigenic determinant in an antigen binding molecule for one distinct antigenic determinant. As such, the term "bivalent" denotes the presence of two biding sites specific for a certain antigenic determinant, respectively, in an antigen-binding molecule. In particular aspects of the invention, the bispecific antigen binding molecules are also bivalent for each antigenic determinant, meaning in that context they have two binding sites specific for CD137 and two binding sites specific for FAP.

The terms "complementarity determining region," and "CDR," are known in the art to refer to non-contiguous sequences of amino acids within antibody variable regions, which confer antigen specificity and binding affinity. In general, there are three (3) CDRs in each heavy chain variable region (CDR-H1, CDR-H2, CDR-H3) and three (3) CDRs in each light chain variable region (CDR-L1, CDR-L2, CDR-L3).

The amino acid sequence boundaries of a given CDR can be determined using any of a number of known schemes, including those described by Kabat et al. (1991), "Sequences of Proteins of Immunological Interest," 5th Ed. Public Health Service, National Institutes of Health, Bethesda, Md. ("Kabat" numbering scheme), A1-Lazikani et al., (1997) JMB 273, 927-948 ("Chothia" numbering scheme), MacCallum et al., J. Mol. Biol. 262:732-745 (1996), "Antibody-antigen interactions: Contact analysis and binding site topography," J. Mol. Biol. 262, 732-745." (Contact" numbering scheme), Lefranc M P et al., "IMGT unique numbering for immunoglobulin and T cell receptor variable domains and Ig superfamily V-like domains," Dev Comp Immunol, 2003 January; 27(1):55-77 ("IMGT" or "CCG" numbering scheme), and Honegger A and Pltickthun A, "Yet another numbering scheme for immunoglobulin variable domains: an automatic modeling and analysis tool," J Mol Biol, 2001 Jun. 8; 309(3):657-70.

The boundaries of a given CDR may vary depending on the naming convention. The amino acid positions assigned to CDRs and FRs can be defined for example according to the numbering system, wherein the specific amino acids of the variable regions of the antibodies of the invention are numbered in sequence starting with the N-terminus as amino acid "1" of the molecule and ending with the C-terminus of the molecule, and wherein the boundaries of the CDRs are defined by the amino acid numbering below:

TABLE 2A

CD137 #1-6 VH/VL CDRs 1-3

| VH | HCDR1 | H CDR2 | H CDR3 |
|---|---|---|---|
| KABAT | 31-35 | 50-66 | 99-108 |
| CHOTHIA | 26-32 | 52-57 | 100-107 |
| CCG | 26-35 | 50-66 | 97-108 |
| IMGT | 24-33 | 51-58 | 97-108 |

| VL | LCDR1 | L CDR2 | LCDR3 |
|---|---|---|---|
| KABAT | 24-34 | 50-56 | 89-97 |
| CHOTHIA | 24-34 | 50-56 | 89-97 |
| CCG | 24-34 | 50-56 | 89-97 |
| IMGT | 27-32 | 50-52 | 89-97 |

TABLE 2B

CD137 #7-10 VH/VL CDRs 1-3

| VH | HCDR1 | H CDR2 | H CDR3 |
|---|---|---|---|
| KABAT | 31-35 | 50-65 | 98-107 |
| CHOTHIA | 26-32 | 52-56 | 99-106 |
| CCG | 26-35 | 50-65 | 98-107 |
| IMGT | 26-33 | 51-57 | 96-107 |

| VL | LCDR1 | L CDR2 | LCDR3 |
|---|---|---|---|
| KABAT | 24-39 | 55-61 | 94-102 |
| CHOTHIA | 24-39 | 55-61 | 94-102 |
| CCG | 24-39 | 55-61 | 94-102 |
| IMGT | 27-37 | 55-57 | 94-102 |

TABLE 2C

FAP #1-3 VH/VL CDRs 1-3

| VH | HCDR1 | H CDR2 | H CDR3 |
|---|---|---|---|
| KABAT | 31-35 | 50-65 | 98-106 |
| CHOTHIA | 26-32 | 52-56 | 98-106 |
| CCG | 26-35 | 50-65 | 98-106 |
| IMGT | 26-33 | 51-57 | 96-106 |

| VL | LCDR1 | L CDR2 | LCDR3 |
|---|---|---|---|
| KABAT | 24-34 | 50-56 | 89-98 |
| CHOTHIA | 24-34 | 50-56 | 89-98 |
| CCG | 24-34 | 50-56 | 89-98 |
| IMGT | 27-32 | 50-52 | 89-98 |

TABLE 2D

FAP #4-5 VH/VL CDRs 1-3

| VH | HCDR1 | H CDR2 | H CDR3 |
|---|---|---|---|
| KABAT | 32-36 | 51-67 | 100-109 |
| CHOTHIA | 27-33 | 53-58 | 100-109 |
| CCG | 27-36 | 51-67 | 100-109 |
| IMGT | 27-34 | 52-59 | 98-109 |

| VL | LCDR1 | L CDR2 | LCDR3 |
|---|---|---|---|
| KABAT | 24-34 | 50-56 | 89-99 |
| CHOTHIA | 24-34 | 50-56 | 89-99 |
| CCG | 24-34 | 50-56 | 89-99 |
| IMGT | 27-37 | 50-52 | 89-99 |

For example, according to the Kabat convention for CD137 #1-6 the VH CDRs are positioned as follows: residues 31-35 (CDR1), 50-66 (CDR2), and 99-108 (CDR3). Also, according to the Kabat numbering system for CD137 #1-6, the VL CDRs are positioned as follows: residues 24-34 (CDR1), 50-56 (CDR2), and 89-97 (CDR3). According to the Kabat convention for CD137 VH #7-10 the VH CDRs are positioned as follows: residues 31-35 (CDR1), 50-65 (CDR2), and 98-107 (CDR3). Also, according to the Kabat numbering system for CD137 #7-10, VL CDRs are positioned as follows: residues 24-39 (CDR1), 55-61 (CDR2), and 94-102 (CDR3).

Within the context of this invention, reference to CDRs is based on the definition of the Kabat convention, however, the present disclosure is not limited to FRs and CDRs as defined by any one numbering system, but includes all numbering systems, including those discussed above.

Thus, unless otherwise specified, the terms "CDR" and "complementary determining region" of a given antibody or region thereof, such as a variable region, as well as individual CDRs (e.g., "CDR-H1, CDR-H2) and framework regions (FRs) of the antibody or region thereof, should be understood to encompass respective region (e.g., the complementary determining region) as defined by any of the known schemes described herein above. In some instances, the scheme for identification of a particular CDR or CDRs is specified, such as the CDR as defined by the Kabat, Chothia, CCG, IMGT, or other methods known in the art. In other cases, the particular amino acid sequence of a CDR is given. The alternative naming conventions for each of the CDR regions of the invention are in Tables 3A-H below:

TABLE 3A

CD137 #1-#10 VH/VL CDRS according to the KABAT Nomenclature:

| | KABAT SEQ | SEQ ID NO: | Amino Acid # |
|---|---|---|---|
| | CD137 (#1) | | |
| HCDR1 | DFYMA | SEQ ID NO: 290 | 31-35 |
| HCDR2 | NINYDG SSTYYLDSLKS | SEQ ID NO: 8 | 50-66 |
| HCDR3 | EGDEGWYFDV | SEQ ID NO: 9 | 99-108 |
| LCDR1 | KASQDVSTAVA | SEQ ID NO: 12 | 24-34 |
| LCDR2 | SASYRYT | SEQ ID NO: 13 | 50-56 |
| LCDR3 | QQHYSNPWT | SEQ ID NO: 14 | 89-97 |
| | CD137 #2 | | |
| HCDR1 | DFYMS | SEQ ID NO: 295 | 31-35 |
| HCDR2 | NINYEG SSKYYVESVKG | SEQ ID NO: 18 | 50-66 |
| HCDR3 | EGDEGWYFDV | SEQ ID NO: 9 | 99-108 |
| LCDR1 | KASQDISSAVA | SEQ ID NO: 22 | 24-34 |
| LCDR2 | SASSRYT | SEQ ID NO: 23 | 50-56 |
| LCDR3 | QQHYSNPWT | SEQ ID NO: 14 | 89-97 |
| | CD137 #3 | | |
| HCDR1 | DFYMS | SEQ ID NO: 295 | 31-35 |
| HCDR2 | NINYEASSKYYVDSLKG | SEQ ID NO: 28 | 50-66 |
| HCDR3 | EGDEGWYFDV | SEQ ID NO: 9 | 99-108 |
| LCDR1 | RASQSVSSALA | SEQ ID NO: 32 | 24-34 |
| LCDR2 | AASYRQS | SEQ ID NO: 33 | 50-56 |
| LCDR3 | QQHYSNPWT | SEQ ID NO: 14 | 89-97 |
| | CD137 #4 | | |
| HCDR1 | DFYMS | SEQ ID NO: 295 | 31-35 |
| HCDR2 | NIQYEGSSKYYVESLKG | SEQ ID NO: 38 | 50-66 |
| HCDR3 | EGDEGWYFDV | SEQ ID NO: 9 | 99-108 |
| LCDR1 | RASQSISTAVA | SEQ ID NO: 42 | 24-34 |
| LCDR2 | AASYLYS | SEQ ID NO: 43 | 50-56 |
| LCDR3 | QQHYSNPWT | SEQ ID NO: 14 | 89-97 |
| | CD137 #5 | | |
| HCDR1 | DFYMS | SEQ ID NO: 295 | 31-35 |
| HCDR2 | NIQYEG SSKYYVESLKG | SEQ ID NO: 48 | 50-66 |
| HCDR3 | EGDEGWYFDV | SEQ ID NO: 9 | 99-108 |
| LCDR1 | RASQSISTALA | SEQ ID NO: 52 | 24-34 |
| LCDR2 | AASYRYS | SEQ ID NO: 53 | 50-56 |
| LCDR3 | QQHYSNPWT | SEQ ID NO: 14 | 89-97 |
| | CD137 #6 | | |
| HCDR1 | DFYMS | SEQ ID NO: 295 | 31-35 |
| HCDR2 | NIN YEG SSK YYV ESV KG | SEQ ID NO: 58 | 50-66 |

TABLE 3A-continued

CD137 #1-#10 VH/VL CDRS according to the KABAT Nomenclature:

| | | | | |
|---|---|---|---|---|
| HCDR3 | EGDEGWYFD V | | SEQ ID NO: 9 | 99-108 |
| LCDR1 | RASQSISTALA | | SEQ ID NO: 62 | 24-34 |
| LCDR2 | AASYRYS | | SEQ ID NO: 63 | 50-56 |
| LCDR3 | QQHYSNPWT | | SEQ ID NO: 14 | 89-97 |

KABAT CONSENSUS (#1-6)

| | | X | SEQ ID NO: | |
|---|---|---|---|---|
| HCDR1 | DFYM$X_1$ | X1 = A or S | SEQ ID NO: 672 | 31-35 |
| HCDR2 | NI$X_1$ Y$X_2$$X_3$SS$X_4$YY$X_5$$X_6$S$X_7$K$X_8$ | X1 = N, Q; X2 = D, E; X3 = G, A; X4 = T, K; X5 = L, V; X6 = D, E; X7 = L, V; X8 = S, G | SEQ ID NO: 335 | 50-66 |
| HCDR3 | EGDEGWYFDV | | SEQ ID NO: 9 | 99-108 |
| LCDR1 | $X_1$ASQ $X_2$$X_3$ S$X_4$A$X_5$A | X1 = K, R; X2 = D, S; X3 = V, I; X4 = T, S; X5 = V, L | SEQ ID NO: 336 | 24-34 |
| LCDR2 | $X_1$ AS $X_2$$X_3$$X_4$$X_5$ | X1 = S, A; X2 = S, Y; X3 = R, L; X4 = Y, Q; X5 = S, T | SEQ ID NO: 337 | 50-56 |
| LCDR3 | QQHYSNPWT | | SEQ ID NO: 14 | 89-97 | anti-CD137 (#7)

| | | | |
|---|---|---|---|
| HCDR1 | SYYWS | SEQ ID NO: 308 | 31-35 |
| HCDR2 | YIYYSGSTNYNPSLKS | SEQ ID NO: 68 | 50-65 |
| HCDR3 | DQSGGGSFQH | SEQ ID NO: 69 | 98-107 |
| LCDR1 | RSSQSLLYSNGYNHLD | SEQ ID NO: 72 | 24-39 |
| LCDR2 | LGSNRAS | SEQ ID NO: 73 | 55-61 |
| LCDR3 | MQALQTPPT | SEQ ID NO: 74 | 94-102 | anti-CD137 #8

| | | | |
|---|---|---|---|
| HCDR1 | SYYWS | SEQ ID NO: 308 | 31-35 |
| HCDR2 | YIYYSGSTNINPSLKS | SEQ ID NO: 78 | 50-65 |
| HCDR3 | DQSGGGSFQH | SEQ ID NO: 69 | 98-107 |
| LCDR1 | RSSQSLLYSNGYNHLD | SEQ ID NO: 72 | 24-39 |
| LCDR2 | LGSNRAS | SEQ ID NO: 73 | 55-61 |
| LCDR3 | MQALQTPPT | SEQ ID NO: 74 | 94-102 | anti-CD137 #9

| | | | |
|---|---|---|---|
| HCDR1 | SYYWS | SEQ ID NO: 308 | 31-35 |
| HCDR2 | YIYYSGSTNINPSLKS | SEQ ID NO: 88 | 50-65 |
| HCDR3 | DQSGGGSFQH | SEQ ID NO: 69 | 98-107 |
| LCDR1 | RSSQSLLYSQGYNHLD | SEQ ID NO: 92 | 24-39 |
| LCDR2 | GGSNRAS | SEQ ID NO: 93 | 55-61 |
| LCDR3 | MQALQTPPT | SEQ ID NO: 74 | 94-102 |

TABLE 3A-continued

CD137 #1-#10 VH/VL CDRS according to the KABAT Nomenclature:

anti-CD137 #10

| | | | |
|---|---|---|---|
| HCDR1 | SYYWS | SEQ ID NO: 308 | 31-35 |
| HCDR2 | YIYYSGSTQYNPSLKS | SEQ ID NO: 98 | 50-65 |
| HCDR3 | DQSGGGSFQH | SEQ ID NO: 69 | 98-107 |
| LCDR1 | RSSQSLLYSQGYNHLD | SEQ ID NO: 92 | 24-39 |
| LCDR2 | GGSNRAS | SEQ ID NO: 93 | 55-61 |
| LCDR3 | MQALQTPPT | SEQ ID NO: 74 | 94-102 |

KABAT CONSENSUS (#7-10)

| | | X | SEQ ID NO: | |
|---|---|---|---|---|
| HCDR1 | SYYWS | | SEQ ID NO: 308 | 31-35 |
| HCDR2 | YIYYSGSTX$_1$X$_2$NPSLKS | X1 = N, Q; X2 = Y, I | SEQ ID NO: 338 | 50-65 |
| HCDR3 | DQSGGGSFQH | | SEQ ID NO: 69 | 98-107 |
| LCDR1 | RSSQSLLYSX$_1$GYNHLD | X1 = N, Q | SEQ ID NO: 669 | 24-39 |
| LCDR2 | X$_1$GSNRAS | X1 = L, G | SEQ ID NO: 339 | 55-61 |
| LCDR1 | MQALQTPPT | | SEQ ID NO: 74 | 94-102 |

TABLE 3B

CD137 #1-10 VH/VL CDRS according to the CHOTHIA Nomenclature:

| | CHOTHIA SEQ | SEQ ID NO: | Amino Acid # |
|---|---|---|---|
| | CD137 #1 | | |
| HCDR1 | GFTFSDF | SEQ ID NO: 291 | 26-32 |
| HCDR2 | NY<u>D</u>GSS | SEQ ID NO: 292 | 52-57 |
| HCDR3 | GDEGWYFD | SEQ ID NO: 675 | 100-107 |
| LCDR1 | KASQDVSTAVA | SEQ ID NO: 12 | 24-34 |
| LCDR2 | SASYRYT | SEQ ID NO: 13 | 50-56 |
| LCDR3 | QQHYSNPWT | SEQ ID NO: 14 | 89-97 |
| | CD137 (#2) | | |
| HCDR1 | GFTFSDF | SEQ ID NO: 291 | 26-32 |
| HCDR2 | NYEGSS | SEQ ID NO: 296 | 52-57 |
| HCDR3 | GDEGWYFD | SEQ ID NO: 675 | 100-107 |
| LCDR1 | KASQDISSAVA | SEQ ID NO: 22 | 24-34 |
| LCDR2 | SASSRYT | SEQ ID NO: 23 | 50-56 |
| LCDR3 | QQHYSNPWT | SEQ ID NO: 14 | 89-97 |
| | CD137 (#3) | | |
| HCDR1 | GFTFSDF | SEQ ID NO: 291 | 26-32 |
| HCDR2 | NYEASS | SEQ ID NO: 299 | 52-57 |
| HCDR3 | GDEGWYFD | SEQ ID NO: 675 | 100-107 |
| LCDR1 | RASQSVSSALA | SEQ ID NO: 32 | 24-34 |

TABLE 3B-continued

CD137 #1-10 VH/VL CDRS according to the CHOTHIA Nomenclature:

| | | | |
|---|---|---|---|
| LCDR2 | AASYRQS | SEQ ID NO: 33 | 50-56 |
| LCDR3 | QQHYSNPWT | SEQ ID NO: 14 | 89-97 |

CD137 (#4)

| | | | |
|---|---|---|---|
| HCDR1 | GFTFSDF | SEQ ID NO: 291 | 26-32 |
| HCDR2 | QYEGSS | SEQ ID NO: 302 | 52-57 |
| HCDR3 | GD EGWYFD | SEQ ID NO: 675 | 100-107 |
| LCDR1 | RASQSISTAVA | SEQ ID NO: 42 | 24-34 |
| LCDR2 | AASYLYS | SEQ ID NO: 43 | 50-56 |
| LCDR3 | QQHYSNPWT | SEQ ID NO: 14 | 89-97 |

CD137 (#5)

| | | | |
|---|---|---|---|
| HCDR1 | GFTFSDF | SEQ ID NO: 291 | 26-32 |
| HCDR2 | QYEGSS | SEQ ID NO: 302 | 52-57 |
| HCDR3 | GDEGWYFD | SEQ ID NO: 675 | 100-107 |
| LCDR1 | RASQSISTALA | SEQ ID NO: 52 | 24-34 |
| LCDR2 | AASYRYS | SEQ ID NO: 53 | 50-56 |
| LCDR3 | QQHYSNPWT | SEQ ID NO: 14 | 89-97 |

CD137 (#6)

| | | | |
|---|---|---|---|
| HCDR1 | GFTFSDF | SEQ ID NO: 291 | 26-32 |
| HCDR2 | NYEGSS | SEQ ID NO: 296 | 52-57 |
| HCDR3 | GDEGWYFD | SEQ ID NO: 675 | 100-107 |
| LCDR1 | RASQSISTALA | SEQ ID NO: 62 | 24-34 |
| LCDR2 | AASYRYS | SEQ ID NO: 63 | 50-56 |
| LCDR3 | QQHYSNPWT | SEQ ID NO: 14 | 89-97 |

CHOTHIA CONSESUS (#1-6)

| | | X | SEQ ID NO: | |
|---|---|---|---|---|
| HCDR1 | GFTFSDF | | SEQ ID NO: 291 | 26-32 |
| HCDR2 | $X_1$ Y$X_2$$X_3$SS | X1 = N, Q; X2 = D, E; X3 = G, A | SEQ ID NO: 673 | 52-57 |
| HCDR3 | QSGGGSFQ | | SEQ ID NO: 682 | 100-107 |
| LCDR1 | $X_1$ASQ $X_2$$X_3$ S$X_4$A$X_5$A | X1 = K, R; X2 = D, S; X3 = V, I; X4 = T, S; X5 = V, L | SEQ ID NO: 336 | 24-34 |
| LCDR2 | $X_1$ AS $X_2$$X_3$$X_4$$X_5$ | X1 = S, A; X2 = S, Y; X3 = R, L; X4 = Y, Q; X5 = S, T | SEQ ID NO: 337 | 50-56 |
| LCDR3 | QQHYSNPWT | | SEQ ID NO: 14 | 89-97 | anti-CD137 (#7)

| | | | |
|---|---|---|---|
| HCDR1 | GGSISSY | SEQ ID NO: 309 | 26-32 |
| HCDR2 | YYSGS | SEQ ID NO: 310 | 52-56 |
| HCDR3 | QSGGGSFQ | SEQ ID NO: 682 | 99-106 |
| LCDR1 | RSSQSLLYSNGYNHLD | SEQ ID NO: 72 | 24-39 |
| LCDR2 | LGSNRAS | SEQ ID NO: 73 | 55-61 |
| LCDR3 | MQALQTPPT | SEQ ID NO: 74 | 94-102 |

TABLE 3B-continued

CD137 #1-10 VH/VL CDRS according to the CHOTHIA Nomenclature:

anti-CD137 (#8)

| | | | |
|---|---|---|---|
| HCDR1 | GGSISSY | SEQ ID NO: 309 | 26-32 |
| HCDR2 | YYSGS | SEQ ID NO: 310 | 52-56 |
| HCDR3 | QSGGGSFQ | SEQ ID NO: 682 | 99-106 |
| LCDR1 | RSSQSLLYSNGYNHLD | SEQ ID NO: 72 | 24-39 |
| LCDR2 | LGSNRAS | SEQ ID NO: 73 | 55-61 |
| LCDR3 | MQALQTPPT | SEQ ID NO: 74 | 94-102 | anti-CD137 (#9)

| | | | |
|---|---|---|---|
| HCDR1 | GGSISSY | SEQ ID NO: 309 | 26-32 |
| HCDR2 | YYSGS | SEQ ID NO: 310 | 52-56 |
| HCDR3 | QSGGGSFQ | SEQ ID NO: 682 | 99-106 |
| LCDR1 | RSSQSLLYSQGYNHLD | SEQ ID NO: 92 | 24-39 |
| LCDR2 | GGSNRAS | SEQ ID NO: 93 | 55-61 |
| LCDR3 | MQALQTPPT | SEQ ID NO: 74 | 94-102 | anti-CD137 (#10)

| | | | |
|---|---|---|---|
| HCDR1 | GGSISSY | SEQ ID NO: 309 | 26-32 |
| HCDR2 | YYSGS | SEQ ID NO: 310 | 52-56 |
| HCDR3 | QSGGGSFQ | SEQ ID NO: 682 | 99-106 |
| LCDR1 | RSSQSLLYSQGYNHLD | SEQ ID NO: 92 | 24-39 |
| LCDR2 | GGSNRAS | SEQ ID NO: 93 | 55-61 |
| LCDR3 | MQALQTPPT | SEQ ID NO: 74 | 94-102 |

CHOTHIA CONSESUS (#7-10)

| | | X | SEQ ID NO: | |
|---|---|---|---|---|
| HCDR1 | GGSISSY | | SEQ ID NO: 309 | 26-32 |
| HCDR2 | YYSGS | | SEQ ID NO: 310 | 52-56 |
| HCDR3 | QSGGGSFQ | | SEQ ID NO: 682 | 99-106 |
| LCDR1 | RSSQSLLYSX$_1$GYNHLD | X1 = N, Q | SEQ ID NO: 669 | 24-39 |
| LCDR2 | X$_1$GSNRAS | X1 = L, G | SEQ ID NO: 339 | 55-61 |
| LCDR3 | MQALQTPPT | | SEQ ID NO: 74 | 94-102 |

TABLE 3C

CD137 #1-10 VH/VL CDRS according to the CCG Nomenclature:

| | CCG SEQ | SEQ ID NO: | Amino Acid # |
|---|---|---|---|
| | CD137 (#1) | | |
| HCDR1 | GFTFSDFYMA | SEQ ID NO: 7 | 26-35 |
| HCDR2 | NINYDGSSTYYLDSLKS | SEQ ID NO: 8 | 50-66 |
| HCDR3 | EGDEGWYFDV | SEQ ID NO: 9 | 99-108 |
| LCDR1 | KASQDVSTAVA | SEQ ID NO: 12 | 24-34 |

TABLE 3C-continued

CD137 #1-10 VH/VL CDRS according to the CCG Nomenclature:

| | | | |
|---|---|---|---|
| LCDR2 | SASYRYT | SEQ ID NO: 13 | 50-56 |
| LCDR3 | QQHYSNPWT | SEQ ID NO: 14 | 89-97 |
| | CD137 (#2) | | |
| HCDR1 | GFTFSDFYMS | SEQ ID NO: 17 | 26-35 |
| HCDR2 | NINYEGSSKYYVESVKG | SEQ ID NO: 18 | 50-66 |
| HCDR3 | EGDEGWYFDV | SEQ ID NO: 19 | 99-108 |
| LCDR1 | KASQDISSAVA | SEQ ID NO: 22 | 24-34 |
| LCDR2 | SASSRYT | SEQ ID NO: 23 | 50-56 |
| LCDR3 | QQHYSNPWT | SEQ ID NO: 24 | 89-97 |
| | CD137 (#3) | | |
| HCDR1 | GFTFSDFYMS | SEQ ID NO: 27 | 26-35 |
| HCDR2 | NINYEASSKYYVDSLKG | SEQ ID NO: 28 | 50-66 |
| HCDR3 | EGDEGWYFDV | SEQ ID NO: 29 | 99-108 |
| LCDR1 | RASQSVSSALA | SEQ ID NO: 32 | 24-34 |
| LCDR2 | AASYRQS | SEQ ID NO: 33 | 50-56 |
| LCDR3 | QQHYSNPWT | SEQ ID NO: 34 | 89-97 |
| | CD137 (#4) | | |
| HCDR1 | GFTFSDFYMS | SEQ ID NO: 37 | 26-35 |
| HCDR2 | NIQYEGSSKYYVESLKG | SEQ ID NO: 38 | 50-66 |
| HCDR3 | EGDEGWYFDV | SEQ ID NO: 39 | 99-108 |
| LCDR1 | RASQSISTAVA | SEQ ID NO: 42 | 24-34 |
| LCDR2 | AASYLYS | SEQ ID NO: 43 | 50-56 |
| LCDR3 | QQHYSNPWT | SEQ ID NO: 44 | 89-97 |
| | CD137 (#5) | | |
| HCDR1 | GFTFSDFYMS | SEQ ID NO: 47 | 26-35 |
| HCDR2 | NIQYEGSSKYYVESLKG | SEQ ID NO: 48 | 50-66 |
| HCDR3 | EGDEGWYFDV | SEQ ID NO: 49 | 99-108 |
| LCDR1 | RASQSISTALA | SEQ ID NO: 52 | 24-34 |
| LCDR2 | AASYRYS | SEQ ID NO: 53 | 50-56 |
| LCDR3 | QQHYSNPWT | SEQ ID NO: 54 | 89-97 |
| | CD137 (#6) | | |
| HCDR1 | GFTFSDFYMS | SEQ ID NO: 57 | 26-35 |
| HCDR2 | NINYEGSSKYYVESVKG | SEQ ID NO: 58 | 50-66 |
| HCDR3 | EGDEGWYFDV | SEQ ID NO: 59 | 99-108 |
| LCDR1 | RASQSISTALA | SEQ ID NO: 62 | 24-34 |
| LCDR2 | AASYRYS | SEQ ID NO: 63 | 50-56 |
| LCDR3 | QQHYSNPWT | SEQ ID NO: 64 | 89-97 |

TABLE 3C-continued

CD137 #1-10 VH/VL CDRS according to the CCG Nomenclature:

CCG CONSENSUS (#1-#6)

| | | X | SEQ ID NO: | |
|---|---|---|---|---|
| HCDR1 | GTFSDFYMX$_1$ | X1 = A or S | SEQ ID NO: 348 | 26-35 |
| HCDR2 | NIX$_1$ YX$_2$X$_3$SSX$_4$YYX$_5$X$_6$SX$_7$KX$_8$ | X1 = N, Q; X2 = D, E; X3 = G, A; X4 = T, K; X5 = L, V; X6 = D, E; X7 = L, V; X8 = S, G | SEQ ID NO: 335 | 50-66 |
| HCDR3 | EGDEGWYFD V | | SEQ ID NO: 9 | 99-108 |
| LCDR1 | X$_1$ASQ X$_2$X$_3$ SX$_4$AX$_5$A | X1 = K, R; X2 = D, S; X3 = V, I; X4 = T, S; X5 = V, L | SEQ ID NO: 336 | 24-34 |
| LCDR2 | X$_1$ AS X$_2$X$_3$X$_4$X$_5$ | X1 = S, A; X2 = S, Y; X3 = R, L; X4 = Y, Q; X5 = S, T | SEQ ID NO: 337 | 50-56 |
| LCDR3 | QQHYSNPWT | | SEQ ID NO: 14 | 89-97 | anti-CD137 (#7)

| | | | |
|---|---|---|---|
| HCDR1 | GGSISSYYWS | SEQ ID NO: 67 | 26-35 |
| HCDR2 | YIYYSGSTNYNPSLKS | SEQ ID NO: 68 | 50-65 |
| HCDR3 | DQSGGGSFQH | SEQ ID NO: 69 | 98-107 |
| LCDR1 | RSSQSLLYSNGYNHLD | SEQ ID NO: 72 | 24-39 |
| LCDR2 | LGSNRAS | SEQ ID NO: 73 | 55-61 |
| LCDR3 | MQALQTPPT | SEQ ID NO: 74 | 94-102 | anti-CD137 (#8)

| | | | |
|---|---|---|---|
| HCDR1 | GGSISSYYWS | SEQ ID NO: 77 | 26-35 |
| HCDR2 | YIYYSGSTNINPSLKS | SEQ ID NO: 78 | 50-65 |
| HCDR3 | DQSGGGSFQH | SEQ ID NO: 79 | 98-107 |
| LCDR1 | RSSQSLLYSNGYNHLD | SEQ ID NO: 82 | 24-39 |
| LCDR2 | LGSNRAS | SEQ ID NO: 83 | 55-61 |
| LCDR3 | MQALQTPPT | SEQ ID NO: 84 | 94-102 | anti-CD137 (#9)

| | | | |
|---|---|---|---|
| HCDR1 | GGSISSYYWS | SEQ ID NO: 87 | 26-35 |
| HCDR2 | YIY YSG STN INP SLKS | SEQ ID NO: 88 | 50-65 |
| FICDR3 | DQSGGGSFQH | SEQ ID NO: 89 | 98-107 |
| LCDR1 | RSSQSLLYSQGYNHLD | SEQ ID NO: 92 | 24-39 |
| LCDR2 | GGSNRAS | SEQ ID NO: 93 | 55-61 |
| LCDR3 | MQALQTPPT | SEQ ID NO: 94 | 94-102 | anti-CD137 (#10)

| | | | |
|---|---|---|---|
| HCDR1 | GGSISSYYWS | SEQ ID NO: 97 | 26-35 |
| HCDR2 | YIYYSGSTQYNPSLKS | SEQ ID NO: 98 | 50-65 |
| HCDR3 | DQSGGGSFQH | SEQ ID NO: 99 | 98-107 |
| LCDR1 | RSSQSLLYSQGYNHLD | SEQ ID NO: 102 | 24-39 |

TABLE 3C-continued

CD137 #1-10 VH/VL CDRS according to the CCG Nomenclature:

| | | | | |
|---|---|---|---|---|
| LCDR2 | GGSNRAS | | SEQ ID NO: 103 | 55-61 |
| LCDR3 | MQALQTPPT | | SEQ ID NO: 104 | 94-102 |

CCG CONSENSUS (#7-10)

| | | X | SEQ ID NO: | |
|---|---|---|---|---|
| HCDR1 | GGSISSYYWS | | SEQ ID NO: 67 | 26-35 |
| HCDR2 | YIYYSGSTX$_1$X$_2$NPSLKS | X1 = N, Q; X2 = Y, I | SEQ ID NO: 338 | 50-65 |
| HCDR3 | DQSGGGSFQH | | SEQ ID NO: 69 | 98-107 |
| LCDR1 | RSSQSLLYSX$_1$GYNHLD | X1 = N, Q | SEQ ID NO: 669 | 24-39 |
| LCDR2 | X$_1$GSNRAS | X1 = L, G | SEQ ID NO: 339 | 55-61 |
| LCDR3 | MQALQTPPT | | SEQ ID NO: 74 | 94-102 |

TABLE 3D

CD137 #1-10 VH/VL CDRS according to the IMGT Nomenclature:

| | IMGT SEQ | SEQ ID NO: | Amino Acid # |
|---|---|---|---|
| | CD137 (#1) | | |
| HCDR1 | GFTFSDFY | SEQ ID NO: 286 | 26-33 |
| HCDR2 | INYDGSST | SEQ ID NO: 287 | 51-58 |
| HCDR3 | AREGDEGWYFDV | SEQ ID NO: 676 | 97-108 |
| LCDR1 | QDVSTA | SEQ ID NO: 288 | 27-32 |
| LCDR2 | SAS | SEQ ID NO: 678 | 50-52 |
| LCDR3 | QQHYSNPWT | SEQ ID NO: 14 | 89-97 |
| | CD137 (#2) | | |
| HCDR1 | GFTFSDFY | SEQ ID NO: 286 | 26-33 |
| HCDR2 | IN YEG SSK | SEQ ID NO: 293 | 51-58 |
| HCDR3 | AREGDEGWYFDV | SEQ ID NO: 676 | 97-108 |
| LCDR1 | QDISSA | SEQ ID NO: 294 | 27-32 |
| LCDR2 | SAS | SEQ ID NO: 678 | 50-52 |
| LCDR3 | QQHYSNPWT | SEQ ID NO: 14 | 89-97 |
| | CD137 (#3) | | |
| HCDR1 | GFTFSDFY | SEQ ID NO: 286 | 26-33 |
| HCDR2 | INYEASSK | SEQ ID NO: 297 | 51-58 |
| HCDR3 | AREGDEGWYFDV | SEQ ID NO: 676 | 97-108 |
| LCDR1 | QSVSSA | SEQ ID NO: 298 | 27-32 |
| LCDR2 | AAS | SEQ ID NO: 679 | 50-52 |
| LCDR3 | QQHYSNPWT | SEQ ID NO: 14 | 89-97 |
| | CD137 (#4) | | |
| HCDR1 | GFTFSDFY | SEQ ID NO: 286 | 26-33 |
| HCDR2 | IQYEGSSK | SEQ ID NO: 300 | 51-58 |

TABLE 3D-continued

| | CD137 #1-10 VH/VL CDRS according to the IMGT Nomenclature: | | |
|---|---|---|---|
| HCDR3 | AREGDEGWYFDV | SEQ ID NO: 676 | 97-108 |
| LCDR1 | QSISTA | SEQ ID NO: 301 | 27-32 |
| LCDR2 | AAS | SEQ ID NO: 679 | 50-52 |
| LCDR3 | QQHYSNPWT | SEQ ID NO: 14 | 89-97 |
| | CD137 (#5) | | |
| HCDR1 | GFTFSDFY | SEQ ID NO: 286 | 26-33 |
| HCDR2 | IQYEGSSK | SEQ ID NO: 300 | 51-58 |
| HCDR3 | AREGDEGWYFDV | SEQ ID NO: 676 | 97-108 |
| LCDR1 | QSISTA | SEQ ID NO: 301 | 27-32 |
| LCDR2 | AAS | SEQ ID NO: 679 | 50-52 |
| LCDR3 | QQHYSNPWT | SEQ ID NO: 14 | 89-97 |
| | CD137 (#6) | | |
| HCDR1 | GFTFSDFY | SEQ ID NO: 286 | 26-33 |
| HCDR2 | INYEGSSK | SEQ ID NO: 293 | 51-58 |
| HCDR3 | AREGDEGWYFDV | SEQ ID NO: 676 | 97-108 |
| LCDR1 | QSI STA | SEQ ID NO: 301 | 27-32 |
| LCDR2 | AAS | SEQ ID NO: 679 | 50-52 |
| LCDR3 | QQHYSNPWT | SEQ ID NO: 14 | 89-97 |
| | IMGT CONSENSUS (#1-6) | | |
| | IMGT SEQ | X | SEQ ID NO: |
| HCDR1 | GFTFSDFY | | SEQ ID NO: 286 |
| HCDR2 | IX1YX2X3SSX4 | X1 = N, Q; X2 = D, E; X3 = G, A; X4 = T, K | SEQ ID NO: 674* |
| HCDR3 | AREGDEGWYFDV | | SEQ ID NO: 676 |
| LCDR1 | QX1X2SX3A | X1 = D, S; X2 = V, I; X3 = T, S | SEQ ID NO: 677 |
| LCDR2 | X1AS | X1 = S, A | SEQ ID NO: 680 |
| LCDR3 | QQHYSNPWT | | SEQ ID NO: 14 |
| | anti-CD137 (#7) | | |
| HCDR1 | GGSISSYY | SEQ ID NO: 304 | 26-33 |
| HCDR2 | IYYSGST | SEQ ID NO: 305 | 51-57 |
| HCDR3 | ARDQSGGGSFQH | SEQ ID NO: 683 | 96-107 |
| LCDR1 | QSLLYSNGYNH | SEQ ID NO: 306 | 27-37 |
| LCDR2 | LGS | SEQ ID NO: 685 | 55-57 |
| LCDR3 | MQALQTPPT | SEQ ID NO: 74 | 94-102 |
| | anti-CD137 (#8) | | |
| HCDR1 | GGSISSYY | SEQ ID NO: 304 | 26-33 |
| HCDR2 | IYYSGST | SEQ ID NO: 305 | 51-57 |
| HCDR3 | ARDQSGGGSFQH | SEQ ID NO: 683 | 96-107 |
| LCDR1 | QSLLYSNGYNH | SEQ ID NO: 306 | 27-37 |

TABLE 3D-continued

CD137 #1-10 VH/VL CDRS according to the IMGT Nomenclature:

| | | | |
|---|---|---|---|
| LCDR2 | LGS | SEQ ID NO: 685 | 55-57 |
| LCDR3 | MQALQTPPT | SEQ ID NO: 74 | 94-102 | anti-CD137 (#9)

| | | | |
|---|---|---|---|
| HCDR1 | GGSISSYY | SEQ ID NO: 304 | 26-33 |
| HCDR2 | IYYSGST | SEQ ID NO: 305 | 51-57 |
| HCDR3 | ARDQSGGGSFQH | SEQ ID NO: 683 | 96-107 |
| LCDR1 | QSLLYSQGYNH | SEQ ID NO: 313 | 27-37 |
| LCDR2 | GGS | SEQ ID NO: 686 | 55-57 |
| LCDR3 | MQALQTPPT | SEQ ID NO: 74 | 94-102 | anti-CD137 (#10)

| | | | |
|---|---|---|---|
| HCDR1 | GGSISSYY | SEQ ID NO: 304 | 26-33 |
| HCDR2 | IYYSGST | SEQ ID NO: 305 | 51-57 |
| HCDR3 | ARDQSGGGSFQH | SEQ ID NO: 683 | 96-107 |
| LCDR1 | QSLLYSQGYNH | SEQ ID NO: 313 | 27-37 |
| LCDR2 | GGS | SEQ ID NO: 686 | 55-57 |
| LCDR3 | MQALQTPPT | SEQ ID NO: 74 | 94-102 |

IMGT CONSENSUS (#7-10)

| | IMGT SEQ | X | SEQ ID NO: | |
|---|---|---|---|---|
| HCDR1 | GGSISSYY | | SEQ ID NO: 304 | 26-33 |
| HCDR2 | IYYSGST | | SEQ ID NO: 305 | 51-57 |
| HCDR3 | ARDQSGGGSFQH | | SEQ ID NO: 683 | 96-107 |
| LCDR1 | QSLLYSX$_1$GYNH | X1 = N, Q | SEQ ID NO: 684 | 27-37 |
| LCDR2 | X$_1$GS | X1 = L, G | SEQ ID NO: 687 | 55-57 |
| LCDR3 | MQALQTPPT | | SEQ ID NO: 74 | 94-102 |

TABLE 3E

FAP #1-5 VH/VL CDRS according to the KABAT Nomenclature:

| | KABAT SEQ | SEQ ID NO: | Amino Acid # |
|---|---|---|---|

FAP (#1)

| | | | |
|---|---|---|---|
| HCDR1 | NFAMT | SEQ ID NO: 319 | 31-35 |
| HCDR2 | GIRGSGTTYYADSVKG | SEQ ID NO: 108 | 50-65 |
| HCDR3 | TWGTEYFDY | SEQ ID NO: 109 | 98-106 |
| LCDR1 | RASQPINNYLA | SEQ ID NO: 111 | 24-34 |
| LCDR2 | SASNRAT | SEQ ID NO: 112 | 50-56 |
| LCDR3 | QQYYDWPPYT | SEQ ID NO: 113 | 89-98 |

FAP (#2)

| | | | |
|---|---|---|---|
| HCDR1 | NFAMT | SEQ ID NO: 319 | 31-35 |
| HCDR2 | GIRGSGTTYYAESVKG | SEQ ID NO: 117 | 50-65 |

TABLE 3E-continued

FAP #1-5 VH/VL CDRS according to the KABAT Nomenclature:

| | | | |
|---|---|---|---|
| HCDR3 | TWGTEYFDY | SEQ ID NO: 109 | 98-106 |
| LCDR1 | RASQPIRSYLA | SEQ ID NO: 120 | 24-34 |
| LCDR2 | SASNRAT | SEQ ID NO: 112 | 50-56 |
| LCDR3 | QQYYDWPPYT | SEQ ID NO: 113 | 89-98 |

FAP (#3)

| | | | |
|---|---|---|---|
| HCDR1 | NFAMT | SEQ ID NO: 319 | 31-35 |
| HCDR2 | GIRGSGTTYYAESVKG | SEQ ID NO: 126 | 50-65 |
| HCDR3 | TWGTEYFDY | SEQ ID NO: 109 | 98-106 |
| LCDR1 | RASQPISSYLA | SEQ ID NO: 129 | 24-34 |
| LCDR2 | SASNRAT | SEQ ID NO: 112 | 50-56 |
| LCDR3 | QQYYDWPPYT | SEQ ID NO: 113 | 89-98 |

FAP #1-3 KABAT CONSENSUS SEQ

| | KABAT SEQ | X | SEQ ID NO: | Amino Acid # |
|---|---|---|---|---|
| HCDR1 | NFAMT | | SEQ ID NO: 319 | 31-35 |
| HCDR2 | GIRGSGTTYYAX$_1$SVKG | X1 = D, E | SEQ ID NO: 341 | 50-65 |
| HCDR3 | TWGTEYFDY | | SEQ ID NO: 109 | 98-106 |
| LCDR1 | RASQPIX$_1$X$_2$YLA | X1 = N, R S; X2 = N, S | SEQ ID NO: 691 | 24-34 |
| LCDR2 | SASNRAT | | SEQ ID NO: 112 | 50-56 |
| LCDR3 | QQYYDWPPYT | | SEQ ID NO: 113 | 89-98 |

FAP (#4)

| | | | |
|---|---|---|---|
| HCDR1 | NYDMG | SEQ ID NO: 328 | 32-36 |
| HCDR2 | GIRGRGGSTYYADSVKG | SEQ ID NO: 135 | 51-67 |
| HCDR3 | ENNRHSFFEY | SEQ ID NO: 136 | 100-109 |
| LCDR1 | RASQSVGHYLA | SEQ ID NO: 138 | 24-34 |
| LCDR2 | DASNRAI | SEQ ID NO: 139 | 50-56 |
| LCDR3 | QQYYNDWPPLT | SEQ ID NO: 140 | 89-99 |

FAP (#5)

| | | | |
|---|---|---|---|
| HCDR1 | SYDMG | SEQ ID NO: 333 | 32-36 |
| HCDR2 | GIRGRGGSTYYAESVKG | SEQ ID NO: 144 | 51-67 |
| HCDR3 | ENERHSFFEY | SEQ ID NO: 145 | 100-109 |
| LCDR1 | RASQSVGHYLA | SEQ ID NO: 138 | 24-34 |
| LCDR2 | DASNRAI | SEQ ID NO: 139 | 50-56 |
| LCDR3 | QQYYNDWPPLT | SEQ ID NO: 140 | 89-99 |

FAP #4-5 KABAT CONSENSUS SEQ

| | KABAT SEQ | X | SEQ ID NO: | Amino Acid # |
|---|---|---|---|---|
| HCDR1 | X$_1$YDMG | X1 = N, S | SEQ ID NO: 694 | 32-36 |
| HCDR2 | GIRGRGGSTYYAX$_1$SVKG | X = D, E | SEQ ID NO: 342 | 51-67 |
| HCDR3 | ENX$_1$RHSFFEY | X = N, E | SEQ ID NO: 343 | 100-109 |
| LCDR1 | RASQSVGHYLA | | SEQ ID NO: 138 | 24-34 |

TABLE 3E-continued

| FAP #1-5 VH/VL CDRS according to the KABAT Nomenclature: | | | |
|---|---|---|---|
| LCDR2 | DASNRAI | SEQ ID NO: 139 | 50-56 |
| LCDR3 | QQYYNDWPPLT | SEQ ID NO: 140 | 89-99 |

TABLE 3F

| FAP #1-5 VH/VL CDRS according to the CHOTHIA Nomenclature: | | | |
|---|---|---|---|
| | CHOTHIA SEQ | SEQ ID NO: | Amino Acid # |
| | FAP (#1) | | |
| HCDR1 | GFSMSNF | SEQ ID NO: 320 | 26-32 |
| HCDR2 | RGSGT | SEQ ID NO: 321 | 52-56 |
| HCDR3 | TWGTEYFDY | SEQ ID NO: 109 | 98-106 |
| LCDR1 | RASQPINNYLA | SEQ ID NO: 111 | 24-34 |
| LCDR2 | SASNRAT | SEQ ID NO: 112 | 50-56 |
| LCDR3 | QQYYDWPPYT | SEQ ID NO: 113 | 89-98 |
| | FAP (#2) | | |
| HCDR1 | GFSMSNF | SEQ ID NO: 320 | 26-32 |
| HCDR2 | RGSGT | SEQ ID NO: 321 | 52-56 |
| HCDR3 | TWGTEYFDY | SEQ ID NO: 109 | 98-106 |
| LCDR1 | RASQPIRSYLA | SEQ ID NO: 120 | 24-34 |
| LCDR2 | SASNRAT | SEQ ID NO: 112 | 50-56 |
| LCDR3 | QQYYDWPPYT | SEQ ID NO: 113 | 89-98 |
| | FAP (#3) | | |
| HCDR1 | GFSMSNF | SEQ ID NO: 320 | 26-32 |
| HCDR2 | RGSGT | SEQ ID NO: 321 | 52-56 |
| HCDR3 | TWGTEYFDY | SEQ ID NO: 109 | 98-106 |
| LCDR1 | RASQPISSYLA | SEQ ID NO: 129 | 24-34 |
| LCDR2 | SASNRAT | SEQ ID NO: 112 | 50-56 |
| LCDR3 | QQYYDWPPYT | SEQ ID NO: 113 | 89-98 |
| FAP #1-3 CHOTHIA CONSENSUS SEQ | | | Amino |
| CHOTHIA SEQ | X | SEQ ID NO: | Acid # |
| HCDR1 | GFSMSNF | | SEQ ID NO: 320 | 26-32 |
| HCDR2 | RGSGT | | SEQ ID NO: 321 | 52-56 |
| HCDR3 | TWGTYFDY | | SEQ ID NO: 109 | 98-106 |
| LCDR1 | RASQPIX$_1$X$_2$YLA | X1 = N, R S; X2 = N, S | SEQ ID NO: 691* | 24-34 |
| LCDR2 | SASNRAT | | SEQ ID NO: 112 | 50-56 |
| LCDR3 | QQYYDWPPYT | | SEQ ID NO: 113 | 89-98 |
| | FAP #4 | | |
| HCDR1 | GFTFSNY | SEQ ID NO: 329 | 27-33 |
| HCDR2 | RGRGGS | SEQ ID NO: 330 | 53-58 |

TABLE 3F-continued

FAP #1-5 VH/VL CDRS according to the CHOTHIA Nomenclature:

| | | | |
|---|---|---|---|
| HCDR3 | ENNRHSFFEY | SEQ ID NO: 136 | 100-109 |
| LCDR1 | RASQSVGHYLA | SEQ ID NO: 138 | 24-34 |
| LCDR2 | DASNRAI | SEQ ID NO: 139 | 50-56 |
| LCDR3 | QQYYNDWPPLT | SEQ ID NO: 140 | 89-99 |

FAP #5

| | | | |
|---|---|---|---|
| HCDR1 | GFTFSSY | SEQ ID NO: 334 | 27-33 |
| HCDR2 | RGRGGS | SEQ ID NO: 330 | 53-58 |
| HCDR3 | ENERHSFFEY | SEQ ID NO: 145 | 100-109 |
| LCDR1 | RASQSVGHYLA | SEQ ID NO: 138 | 24-34 |
| LCDR2 | DASNRAI | SEQ ID NO: 139 | 50-56 |
| LCDR3 | QQYYNDWPPLT | SEQ ID NO: 140 | 89-99 |

FAP #4-5 CHOTHIA CONSENSUS SEQ

| | CHOTHIA SEQ | X | SEQ ID NO: | |
|---|---|---|---|---|
| HCDR1 | GFTFSX$_1$Y | X1 = N, S | SEQ ID NO: 695 | 27-33 |
| HCDR2 | RGRGGS | | SEQ ID NO: 330 | 53-58 |
| HCDR3 | ENX1RHSFFEY | X = N, E | SEQ ID NO: 343 | 100-109 |
| LCDR1 | RASQSVGHYLA | | SEQ ID NO: 138 | 24-34 |
| LCDR2 | DASNRAI | | SEQ ID NO: 139 | 50-56 |
| LCDR3 | QQYYNDWPPLT | | SEQ ID NO: 140 | 89-99 |

TABLE 3G

FAP #1-5 VH/VL CDRS according to the CCG Nomenclature:

| | CCG SEQ | SEQ ID NO: | Amino Acid # |
|---|---|---|---|

FAP #1

| | | | |
|---|---|---|---|
| HCDR1 | GFSMSNFAMT | SEQ ID NO: 107 | 26-35 |
| HCDR2 | GIRGSGTTYYADSVKG | SEQ ID NO: 108 | 50-65 |
| HCDR3 | TWGTEYFDY | SEQ ID NO: 109 | 98-106 |
| LCDR1 | RASQPINNYLA | SEQ ID NO: 111 | 24-34 |
| LCDR2 | SASNRAT | SEQ ID NO: 112 | 50-56 |
| LCDR3 | QQYYDWPPYT | SEQ ID NO: 113 | 89-98 |

FAP (#2)

| | | | |
|---|---|---|---|
| HCDR1 | GFSMSNFAMT | SEQ ID NO: 116 | 26-35 |
| HCDR2 | GIRGSGTTYYAESVKG | SEQ ID NO: 117 | 50-65 |
| HCDR3 | TWGTEYFDY | SEQ ID NO: 118 | 98-106 |
| LCDR1 | RASQPIRSYLA | SEQ ID NO: 120 | 24-34 |
| LCDR2 | SASNRAT | SEQ ID NO: 121 | 50-56 |
| LCDR3 | QQYYDWPPYT | SEQ ID NO: 122 | 89-98 |

TABLE 3G-continued

FAP #1-5 VH/VL CDRS according to the CCG Nomenclature:

FAP #3

| | | | |
|---|---|---|---|
| HCDR1 | GFSMSNFAMT | SEQ ID NO: 125 | 26-35 |
| HCDR2 | GIRGSGTTYYAESVKG | SEQ ID NO: 126 | 50-65 |
| HCDR3 | TWGTEYFDY | SEQ ID NO: 118 | 98-106 |
| LCDR1 | RASQPISSYLA | SEQ ID NO: 129 | 24-34 |
| LCDR2 | SASNRAT | SEQ ID NO: 130 | 50-56 |
| LCDR3 | QQYYDWPPYT | SEQ ID NO: 131 | 89-98 |

FAP #1-3 CCG CONSENSUS SEQ

| | CCG SEQ | X | SEQ ID NO: | Amino Acid # |
|---|---|---|---|---|
| HCDR1 | GFSMSNFAMT | | SEQ ID NO: 107 | 26-35 |
| HCDR2 | GIRGSGTTYYAX$_1$SVKG | X1 = D, E | SEQ ID NO: 341 | 50-65 |
| HCDR3 | TWGTEYFDY | | SEQ ID NO: 109 | 98-106 |
| LCDR1 | RASQPIX$_1$X$_2$YLA | X1 = N, R S; X2 = N, S | SEQ ID NO: 691 | 24-34 |
| LCDR2 | SASNRAT | | SEQ ID NO: 112 | 50-56 |
| LCDR3 | QQYYDWPPYT | | SEQ ID NO: 113 | 89-98 |

FAP #4

| | | | |
|---|---|---|---|
| HCDR1 | GFTFSNYDMG | SEQ ID NO: 134 | 27-36 |
| HCDR2 | GIRGRGGSTYYADSVKG | SEQ ID NO: 135 | 51-67 |
| HCDR3 | ENNRHSFFEY | SEQ ID NO: 136 | 100-109 |
| LCDR1 | RASQSVGHYLA | SEQ ID NO: 138 | 24-34 |
| LCDR2 | DASNRAI | SEQ ID NO: 139 | 50-56 |
| LCDR3 | QQYYNDWPPLT | SEQ ID NO: 140 | 89-99 |

FAP #5

| | | | |
|---|---|---|---|
| HCDR1 | GFTFSSYDMG | SEQ ID NO: 143 | 27-36 |
| HCDR2 | GIRGRGGSTYYAESVKG | SEQ ID NO: 144 | 51-67 |
| HCDR3 | ENERHSFFEY | SEQ ID NO: 145 | 100-109 |
| LCDR1 | RASQSVGHYLA | SEQ ID NO: 147 | 24-34 |
| LCDR2 | DASNRAI | SEQ ID NO: 148 | 50-56 |
| LCDR3 | QQYYNDWPPLT | SEQ ID NO: 149 | 89-99 |

FAP #4-5 CCG CONSENSUS SEQ

| | CCG SEQ | X | SEQ ID NO: | Amino Acid # |
|---|---|---|---|---|
| HCDR1 | GFTFSX$_1$YDMG | X1 = N, S | SEQ ID NO: 340 | 27-35 |
| HCDR2 | GIRGRGGSTYYAX$_1$SVKG | X = D, E | SEQ ID NO: 342 | 51-67 |
| HCDR3 | ENX$_1$RHSFFEY | X = N, E | SEQ ID NO: 343 | 100-109 |
| LCDR1 | RASQSVGHYLA | | SEQ ID NO: 138 | 24-34 |
| LCDR2 | DASNRAI | | SEQ ID NO: 139 | 50-56 |
| LCDR3 | QQYYNDWPPLT | | SEQ ID NO: 140 | 89-99 |

TABLE 3H

| FAP #1-5 VH/VL CDRS according to the IMGT Nomenclature: | | | |
|---|---|---|---|
| | IMGT SEQ | SEQ ID NO: | Amino Acid # |
| | FAP #1 | | |
| HCDR1 | GFSMSNFA | SEQ ID NO: 315 | 26-33 |
| HCDR2 | IRGSGTT | SEQ ID NO: 316 | 51-57 |
| HCDR3 | AKTWGTEYFDY | SEQ ID NO: 689 | 96-106 |
| LCDR1 | QPINNY | SEQ ID NO: 317 | 27-32 |
| LCDR2 | SAS | SEQ ID NO: 693 | 50-52 |
| LCDR3 | QQYYDWPPYT | SEQ ID NO: 113 | 89-98 |
| | FAP #2 | | |
| HCDR1 | GFSMSNFA | SEQ ID NO: 315 | 26-33 |
| HCDR2 | IRGSGTT | SEQ ID NO: 316 | 51-57 |
| HCDR3 | AKTWGTEYFDY | SEQ ID NO: 689 | 96-106 |
| LCDR1 | QPIRSY | SEQ ID NO: 670 | 27-32 |
| LCDR2 | SAS | SEQ ID NO: 693 | 50-52 |
| LCDR3 | QQYYDWPPYT | SEQ ID NO: 113 | 89-98 |
| | FAP #3 | | |
| HCDR1 | GFSMSNFA | SEQ ID NO: 315 | 26-33 |
| HCDR2 | IRGSGTT | SEQ ID NO: 316 | 51-57 |
| HCDR3 | AKTWGTEYFDY | SEQ ID NO: 689 | 96-106 |
| LCDR1 | QPISSY | SEQ ID NO: 323 | 27-32 |
| LCDR2 | SAS | SEQ ID NO: 693 | 50-52 |
| LCDR3 | QQYYDWPPYT | SEQ ID NO: 113 | 89-98 |
| | FAP #1-3 IMGT CONSENSUS SEQ | | Amino Acid |
| | IMGT SEQ | X | SEQ ID NO: | # |
| HCDR1 | GFSMSNFA | | SEQ ID NO: 315 | 26-33 |
| HCDR2 | IRGSGTT | | SEQ ID NO: 316 | 51-57 |
| HCDR3 | AKTWGTEYFDY | | SEQ ID NO: 689 | 96-106 |
| LCDR1 | QPIX$_1$X$_2$Y | X1 = N, R S; X2 = N, S | SEQ ID NO: 692 | 27-32 |
| LCDR2 | SAS | | SEQ ID NO: 693 | 50-52 |
| LCDR3 | QQYYDWPPYT | | SEQ ID NO: 113 | 89-98 |
| | FAP #4 | | |
| HCDR1 | GFTFSNYD | SEQ ID NO: 324 | 27-34 |
| HCDR2 | IRGRGGST | SEQ ID NO: 325 | 52-59 |
| HCDR3 | AKENNRHSFFEY | SEQ ID NO: 701 | 98-109 |
| LCDR1 | QSVGHY | SEQ ID NO: 326 | 27-32 |
| LCDR2 | DAS | SEQ ID NO: 704 | 50-52 |
| LCDR3 | QQYYNDWPPLT | SEQ ID NO: 140 | 89-99 |

TABLE 3H-continued

FAP #1-5 VH/VL CDRS according to the IMGT Nomenclature:

| | FAP #5 | | |
|---|---|---|---|
| HCDR1 | GFTFSSYD | SEQ ID NO: 331 | 27-34 |
| HCDR2 | IRGRGGST | SEQ ID NO: 325 | 52-59 |
| HCDR3 | AKENERHSFFEY | SEQ ID NO: 702 | 98-109 |
| LCDR1 | QSVGHY | SEQ ID NO: 326 | 27-32 |
| LCDR2 | DAS | SEQ ID NO: 704 | 50-52 |
| LCDR3 | QQYYNDWPPLT | SEQ ID NO: 140 | 89-99 |

| | FAP #4-5 IMGT CONSENSUS SEQ | | | Amino Acid |
|---|---|---|---|---|
| | CCG SEQ | X | SEQ ID NO: | # |
| HCDR1 | GFTFSX$_1$YD | X1 = N, S | SEQ ID NO: 696 | 27-34 |
| HCDR2 | IRGRGGST | | SEQ ID NO: 325 | 52-59 |
| HCDR3 | AKENX$_1$RHSFFEY | X = N, E | SEQ ID NO: 703 | 98-109 |
| LCDR1 | QSVGHY | | SEQ ID NO: 326 | 27-32 |
| LCDR2 | DAS | | SEQ ID NO: 704 | 50-52 |
| LCDR3 | QQYYNDWPPLT | | SEQ ID NO: 140 | 89-99 |

Amino acid sequence modification(s) of the antibodies are contemplated. For example, it may be desirable to improve the binding affinity and/or other biological properties of an antibody. The term "amino acid sequence variants" includes substantial variants wherein there are amino acid substitutions in one or more hypervariable region residues of a parent antigen binding molecule (e.g. a humanized or human antibody). Generally, the resulting variant(s) selected for further study will have modifications in certain biological properties that are suitable for the intended function. These modifications, can include, but are not limited to "improvements" in certain biological properties such as increased affinity or reduced immunogenicity relative to the parent antigen binding molecule and/or will have substantially retained certain biological properties of the parent antigen biding molecule. Amino acid sequence variants may be prepared by introducing appropriate nucleotide changes into the nucleic acid encoding the antibody variant, or by peptide synthesis. Such modifications include, for example, deletions from, and/or insertions into and/or substitutions of, residues within the amino acid sequences of the antibody variants. Any combination of deletion, insertion, and substitution is made to arrive at the final construct, provided that the final construct possesses the desired characteristics. The amino acid changes also may alter post-translational processing of the antibody variants, such as changing the number or position of glycosylation sites.

For example, 1, 2, 3, 4, 5, or 6 amino acids may be inserted, substituted or deleted in each of the CDRs (of course, dependent on their length), while 1, 2, 3, 4, 5, 6, 7, 8, 9, 10, 11, 12, 13, 14, 15, 16, 17, 18, 19, 20, or 25 amino acids may be inserted, substituted or deleted in each of the FRs. Preferably, amino acid sequence insertions into the antibody construct include amino- and/or carboxyl-terminal fusions ranging in length from 1, 2, 3, 4, 5, 6, 7, 8, 9 or 10 residues to polypeptides containing a hundred or more residues, as well as intra-sequence insertions of single or multiple amino acid residues. Additionally, amino acid sequence deletions from the antibody construct at the amino and/or carboxy terminal regions, ranging in length from 1, 2, 3, 4, 5, 6, 7, 8, 9 or 10 residues are contemplated to maximize and/or otherwise modify characteristics desired in the antibody construct in addition to its ability to bind the target antigen.

The sites of greatest interest for substitutional mutagenesis include (but are not limited to) the CDRs of the heavy and/or light chain, in particular the hypervariable regions, but FR alterations in the heavy and/or light chain are also contemplated. The substitutions are preferably conservative substitutions as described herein. Preferably, 1, 2, 3, 4, 5, 6, 7, 8, 9, or 10 amino acids may be substituted in a CDR, while 1, 2, 3, 4, 5, 6, 7, 8, 9, 10, 11, 12, 13, 14, 15, 16, 17, 18, 19, 20, or 25 amino acids may be substituted in the framework regions (FRs), depending on the length of the CDR or FR. For example, if a CDR sequence encompasses 6 amino acids, it is envisaged that one, two or three of these amino acids are substituted. Similarly, if a CDR sequence encompasses 15 amino acids it is envisaged that one, two, three, four, five or six of these amino acids are substituted.

Generally, if amino acids are substituted in one or more or all of the CDRs of the heavy and/or light chain, it is preferred that the then-obtained "substituted" sequence is at least 60% or 65%, more preferably 70% or 75%, even more preferably 80% or 85%, and particularly preferably 90% or 95% identical to the "original" CDR sequence. This means that it is dependent of the length of the CDR to which degree it is identical to the "substituted" sequence. For example, a CDR having 5 amino acids is preferably 80% identical to its substituted sequence in order to have at least one amino acid substituted. Accordingly, the CDRs of the antibody construct may have different degrees of identity to their substituted sequences, e.g., CDRL1 may have 80%, while CDRL3 may have 90%.

The "Fc part" of an antibody is not involved directly in binding of an antibody to an antigen, but exhibit various effector functions A "Fc part of an antibody" is a term well known to the skilled artisan and defined on the basis of papain cleavage of antibodies. Depending on the amino acid sequence of the constant region of their heavy chains, antibodies or immunoglobulins are divided in the classes: IgA, IgD, IgE, IgG and IgM. According to the heavy chain constant regions the different classes of immunoglobulins are called α, δ, ε, γ, and μ respectively. Several of these may be further divided into subclasses (isotypes), e.g. IgG1, IgG2, IgG3, and IgG4, IgA1, and IgA2. The Fc part of an antibody is directly involved in ADCC (antibody dependent cell-mediated cytotoxicity) and CDC (complement-dependent cytotoxicity) based on complement activation, C1q binding and Fc receptor binding. Complement activation (CDC) is initiated by binding of complement factor C1q to the Fc part of most IgG antibody subclasses. While the influence of an antibody on the complement system is dependent on certain conditions, binding to C1q is caused by defined binding sites in the Fc part. Such binding sites are known in the state of the art and described e.g. by Boakie et al., Nature 282 (1975) 742-743, Lukas et al., J. Immunol. 127 (1981) 2555-2560, Brunhouse and Cebra, Mol. Immunol. 16 (1979) 907-917, Burton et al., Nature 288 (1980) 338-344, Thommesen et al., Mol. Immunol. 37 (2000) 995-1004, Idusogie et al., J. Immunol. 164 (2000) 4178-4184, Hezareh et al., J. Virology 75 (2001) 12161-12168, Morgan et al., Immunology 86 (1995) 319-324, EP 0307434. Such binding sites are e.g. L234, L235, D270, N297, E318, K320, K322, P331 and P329 (numbering according to EU index of Kabat). Most crucial among these residues in mediating C1q and Fcgamma receptor binding in IgG1 are L234 and L235 (Hezareh et al., J. Virology 75 (2001) 12161-12168). Antibodies of subclass IgG1 and IgG3 usually show complement activation and C1q and C3 binding, whereas IgG2 and IgG4 do not activate the complement system and do not bind C1q and C3.

In an embodiment of the invention, binding to complement product C1q or Fc gamma receptor by the binding molecule in this invention is ablated by utilization of the IgG1 constant region with directed L to A mutagenesis at positions 234 and 235 (corresponding to amino acids 117 and 118 of human IgG1 SEQ ID NO.:283, and human IgG1KO SEQ ID NO.:284).

The art has further developed antibodies and made them versatile tools in medicine and technology. Thus, in the context of the present invention the terms "antibody molecule" or "antibody" (used synonymously herein) do not only include antibodies as they may be found in nature, comprising e.g. two light chains and two or heavy chains, or just two heavy chains as in camelid species, but furthermore encompasses all molecules comprising at least one paratope with binding specificity to an antigen and structural similarity to a variable domain of an immunoglobulin.

Thus, an antibody may comprise a monoclonal antibody, a human antibody, a humanized antibody, a chimeric antibody, a fragment of an antibody, in particular a Fv, Fab, Fab', or F(ab')2 fragment, a single chain antibody, in particular a single chain variable fragment (scFv), a Small Modular Immunopharmaceutical (SMIP), a domain antibody, a nanobody, a diabody.

Monoclonal antibodies (mAb) are monospecific antibodies that are identical in amino acid sequence. They may be produced by hybridoma technology from a hybrid cell line (called hybridoma) representing a clone of a fusion of a specific antibody-producing B cell with a myeloma (B cell cancer) cell (Kohler G, Milstein C. Continuous cultures of fused cells secreting antibody of predefined specificity. Nature 1975; 256:495-7). Alternatively, monoclonal antibodies may be produced by recombinant expression in host cells (Norderhaug L, Olafsen T, Michaelsen T E, Sandlie I. (May 1997). "Versatile vectors for transient and stable expression of recombinant antibody molecules in mammalian cells." J Immunol Methods 204 (1): 77-87; see also below).

For application in man, it is often desirable to reduce immunogenicity of antibodies originally derived from other species, like mouse. This can be done by construction of chimeric antibodies, or by a process called "humanization". In this context, a "chimeric antibody" is understood to be antibody comprising a sequence part (e.g. a variable domain) derived from one species (e.g. mouse) fused to a sequence part (e.g. the constant domains) derived from a different species (e.g. human). A "humanized antibody" is an antibody comprising a variable domain originally derived from a non-human species, wherein certain amino acids have been mutated to make the overall sequence of that variable domain more closely resemble to a sequence of a human variable domain. Methods of chimerisation and humanization of antibodies are well-known in the art (Billetta R, Lobuglio A F. "Chimeric antibodies". Int Rev Immunol. 1993; 10 (2-3):165-76; Riechmann L, Clark M, Waldmann H, Winter G (1988). "Reshaping human antibodies for therapy". Nature: 332:323).

Furthermore, technologies have been developed for creating antibodies based on sequences derived from the human genome, for example by phage display or use of transgenic animals (WO 90/05144; D. Marks, H. R. Hoogenboom, T. P. Bonnert, J. McCafferty, A. D. Griffiths and G. Winter (1991) "By-passing immunisation. Human antibodies from V-gene libraries displayed on phage." J. Mol. Biol., 222, 581-597; Knappik et al., J. Mol. Biol. 296: 57-86, 2000; S. Carmen and L. Jermutus, "Concepts in antibody phage display". Briefings in Functional Genomics and Proteomics 2002 1(2):189-203; Lonberg N, Huszar D. "Human antibodies from transgenic mice". Int Rev Immunol. 1995; 13(1):65-93; Brüggemann M, Taussig M J. "Production of human antibody repertoires in transgenic mice". Curr Opin Biotechnol. 1997 August; 8(4):455-8). Such antibodies are "human antibodies" in the context of the present invention.

Antibody can also include fragments of immunoglobulins which retain antigen binding properties, like Fab, Fab', or F(ab')2 fragments. Such fragments may be obtained by fragmentation of immunoglobulins e.g. by proteolytic digestion, or by recombinant expression of such fragments. For example, immunoglobulin digestion can be accomplished by means of routine techniques, e.g. using papain or pepsin (WO 94/29348). Papain digestion of antibodies typically produces two identical antigen binding fragments, so-called Fab fragments, each with a single antigen binding site, and a residual Fc fragment. Pepsin treatment yields an F(ab')2. In Fab molecules, the variable domains are each fused to an immunoglobulin constant domain, preferably of human origin. Thus, the heavy chain variable domain may be fused to a CH1 domain (a so-called Fd fragment), and the light chain variable domain may be fused to a CL domain. Fab molecules may be produced by recombinant expression of respective nucleic acids in host cells, see below.

A number of technologies have been developed for placing variable domains of immunoglobulins, or molecules derived from such variable domains, in a different molecular context. These are "immunoglobulin-like" molecules in accordance with the present invention. In some instances, these immunoglobulin-like molecules can be smaller in size compared to naturally occurring immunoglobulins, and may, for example, comprise a single amino acid chain or several amino acid chains. For example, a single-chain variable fragment (scFv) is a fusion of the variable regions of the heavy and light chains of immunoglobulins, linked together with a short linker, usually serine (S) or glycine (G) (WO 88/01649; WO 91/17271; Huston et al; International Reviews of Immunology, Volume 10, 1993, 195-217). "Single domain antibodies" or "nanobodies" harbour an antigen-binding site in a single Ig-like domain (WO 94/04678; WO 03/050531, Ward et al., Nature. 1989 Oct. 12; 341 (6242):544-6; Revets et al., Expert Opin Biol Ther. 5(1):111-24, 2005). One or more single domain antibodies with binding specificity for the same or a different antigen may be linked together. Diabodies are bivalent antibody molecules consisting of two amino acid chains comprising two variable domains (WO 94/13804, Holliger et al., Proc Natl Acad Sci USA. 1993 Jul. 15; 90(14):6444-8). Other examples of antibody-like molecules are immunoglobulin super family antibodies (IgSF; Srinivasan and Roeske, Current Protein Pept. Sci. 2005, 6(2): 185-96). A different concept leads to the so-called Small Modular Immunopharmaceutical (SMIP) which comprises a Fv domain linked to single-chain hinge and effector domains devoid of the constant domain CH1 (WO 02/056910).

In respect of the present invention, the first aspect of the invention provides a immunoglobulin-like binding molecule having at least one antigen binding site that binds specifically to CD137 (4-1BB, TNFRSF9) and at least one antigen binding site that binds specifically to Fibroblast Activation Protein (FAP).

In one aspect, the immunoglobulin-like binding molecule of the present invention binds to the CD137 (4-1BB, TNFRSF9) or Fibroblast Activation Protein (FAP) target antigens with an affinity, as determined e.g. by surface plasmon resonance analysis (Malmqvist M., "Surface plasmon resonance for detection and measurement of antibody-antigen affinity and kinetics.", Curr Opin Immunol. 1993 April; 5(2):282-6), with a KD value ranging from 1 µM to 100 µM, preferably 1 µM to 1 µM. Antibody affinity can also be measured using kinetic exclusion assay (KinExA) technology (Darling, R. J., and Brault P-A., "Kinetic exclusion assay technology: Characterization of Molecular Interactions." ASSAY and Drug Development Technologies. 2004, Dec. 2(6): 647-657).

As used herein, the term "binding" or "specifically binding" refers to the binding of the antibody and/or immunoglobulin-like molecule to an epitope of the antigen in an in-vitro assay, preferably in a surface plasmon resonance assay (SPR, BIAcore, GE-Healthcare Uppsala, Sweden). The affinity of the binding is defined by the terms $k_{on}$ (rate constant for the association of the antibody from the antibody/antigen complex), $k_{off}$ (dissociation constant), and KD ($k_{off}/k_{on}$). Specific binding commonly refers to the formation of a complex between a receptor molecule and its ligands. In the context of antibody-antigen binding, high affinity antibodies typically bind their target antigens at affinities of $10^{-9}$ M or less.

An "antibody that specifically binds to CD137" or "immunoglobulin-like binding molecule that specifically binds to CD137" or an "antibody that specifically binds to FAP" or an "immunoglobulin-like binding molecule that specifically binds to FAP" refers to molecules that are capable of binding with sufficient affinity such that the antibody and/or immunoglobulin-like binding molecule is useful as a diagnostic and/or therapeutic agent in targeting CD137 or FAP, respectively. In one embodiment, the extent of binding of an anti CD137 binding molecule to an unrelated, non-CD137 protein is less than about 10% of the binding of the antibody and/or immunoglobulin-like binding molecule to CD137 as measured, e.g. by a radioimmunoassay (RIA) or flow cytometry (FACs). In certain embodiments, an antibody and/or immunoglobulin-like binding molecule that binds to CD137 has a dissociation constant (Kd) of ≤1 µM, ≤100 nM, ≤10 nM, ≤1 nM, ≤0.1 nM, ≤0.01 nM, ≤0.001 nM. Similarly in one embodiment, the extent of binding of an anti FAP antibody to an unrelated, non-FAP protein is less than about 10% of the binding of the antibody and/or immunoglobulin-like binding molecule to FAP as measured, e.g. by a radioimmunoassay (RIA) or flow cytometry (FACs). In certain embodiments, an antibody and/or immunoglobulin-like binding molecule that binds to FAP has a dissociation constant (Kd) of ≤1 µM, ≤100 nM, ≤10 nM, ≤1 nM, ≤0.1 nM, ≤0.01 nM, ≤0.001 nM (e.g., $10^{-6}$ M or less, from $10^{-50}$ M to $10^{-13}$ M, e.g. $10^{-8}$ M to $10^{-10}$ M).

The binding affinity of an antibody molecule may be enhanced by a process known as affinity maturation (Marks et al., 1992, Biotechnology 10:779-783; Barbas, et al., 1994, Proc. Nat. Acad. Sci, USA 91:3809-3813; Shier et al., 1995, Gene 169:147-155). Affinity matured antibodies or and/or immunoglobulin-like binding molecules are therefore also embraced in the present invention.

In a further preferred embodiment the antigen binding site that binds specifically to CD137 (4-1BB, TNFRSF9) is part of an immunoglobulin (Ig) molecule and the antigen binding site that binds specifically to Fibroblast Activation Protein (FAP) comprises one or more scFv, scFab, Fab or Fv binding elements. Preferably, the antigen binding site that binds specifically to Fibroblast Activation Protein (FAP) comprises two scFv(s).

A "single chain Fv fragment" (scFv) is a polypeptide comprising an antibody heavy chain variable domain (VH), a linker, and an antibody light chain variable domain (VL), and a, wherein said antibody domains and said linker have one of the following orders in N-terminal to C-terminal direction: a) VH-linker-VL, b) VL-linker-VH; and wherein said linker is a polypeptide of 15 and 25 amino acids, preferably 20 amino acids, in length.

In addition, these single chain Fab molecules might be further stabilized by incorporation of disulfide bonds between the VH and VL domains, within the VH domain, or within the VL domain, via incorporation of cysteine residues. The term N-terminus denotes the first amino acid of the polypeptide chain while the term C-terminus denotes the last amino acid of the C-terminus of the polypeptide chain. Hence an embodiment of the invention is wherein the one or more scFv(s) comprises additional cysteine residues to form disulfide bonds As demonstrated in the accompanying examples, the inventors have shown that a FAP scFv having a VL-VH orientation from N-to C-terminus can function in the binding molecules of the invention to induce CD137 cross-linking in target cells. While a FAP scFv having a VH-VL orientation from N- to C-terminus can also function, the activity may be reduced in this orientation. Hence a preferred embodiment of the invention is where the order is VL-VH from N-to C-terminus.

A further preferred embodiment of the invention is wherein the one or more scFv(s) is fused to the Ig molecule by a peptide linker, preferably a peptide linker having a length of about 4 to 20 amino acids. Preferably the scFv is fused to the C-terminus of the heavy chain of the Ig molecule. Preferably the Ig molecule is an IgG.

Methods of linking scFv molecules to the C-terminus of the heavy chain of the IgG molecule are well known in the art. Typically, a small linker sequence of glycine and serine (termed a GS mini-linker) amino acids is used. The number of amino acids in the linker can vary, from four (4) (GGGS) (SEQ ID NO.:279), six (6) (GGSGGS) (SEQ ID NO.:280), ten (10)(GGGGSGGGGS) (SEQ ID NO.:281), twenty (20) (GGGGSGGGGSGGGGSGGGGS) (SEQ ID NO.:282) or more. In practice, normally the linker is formed by combining the nucleic acid molecule encoding the IgG of interest (which is the present case would include the nucleic acid encoding the variable domain of the heavy chain for the CD137 (4-1BB, TNFRSF9) binding site) with the nucleic acid encoding the desired scFv (which is the present case would include the nucleic acid encoding the variable domain of the heavy chain for the Fibroblast Activation Protein (FAP) binding site) interspaced by the nucleic acid molecule encoding the linker sequence. Then as further explained below this complete HC-scFv encoding nucleic acid molecule is placed within an expression vector and introduced to appropriate host cells such that the complete IgG heavy chain-scFv single polypeptide is formed.

Preferably the GS linker is GGGGSGGGGSGGGGSGGGGS (SEQ ID NO.:282).

The immunoglobulin-like binding molecule may be fused (as a fusion protein) or otherwise linked (by covalent or non-covalent bonds) to other molecular entities having a desired impact on the properties of the antibody molecule. For example, it may be desirable to improve pharmacokinetic properties of antibody molecules, stability e.g. in body fluids such as blood, in particular in the case of single chain antibodies or domain antibodies. A number of technologies have been developed in this regard, in particular to prolong the half-life of such antibody molecules in the circulation, such as pegylation (WO 98/25971; WO 98/48837; WO 2004081026), fusing or otherwise covalently attaching the antibody molecule to another antibody molecule having affinity to a serum protein like albumin (WO 2004041865; WO 2004003019), or expression of the antibody molecule as fusion protein with all or part of a serum protein like albumin or transferrin (WO 2001079258).

Since the Fc region of a naturally occurring antibody interacts with a number of Fc receptors, which results in a number of important functional capabilities (which are referred to as "effector functions"). The immunoglobulin-like binding molecule of the invention contains a portion of the Fc region, that has been engineered to avoid unintended cross-linking by soluble Fc gamma receptors or complement C1q. In one embodiment, such antibody variant has much lower affinities to Fcgamma receptors and complement C1q than the parent antibody. Hence an embodiment of the invention is wherein the Ig molecule comprises a Fc variant having a reduced affinity to Fc gamma receptors or complement receptors, or both compared to a wildtype Fc region.

A further embodiment of the invention is wherein the binding molecule of the invention comprises an Fc region, or the relevant section thereof, that has been engineered to modify serum levels (half-life) by optimizing its interaction with the neonatal Fc receptor (FcRn).

Methods of preparing binding sites that bind to specific target antigens are well known in the art. The skilled person can readily use these methods to devise a binding site have the necessary specificity for the CD137 (4-1BB, TNFRSF9) or Fibroblast Activation Protein (FAP) target antigens.

Methods of generating antibodies and antibody fragments are well known in the art. For example, antibodies may be generated via any one of several methods which employ induction of in vivo production of antibody molecules, screening of immunoglobulin libraries (Orlandi et al, 1989. Proc. Natl. Acad. Sci. U.S.A. 86:3833-3837; Winter et al 1991, Nature 349:293-299) or generation of monoclonal antibody molecules by cell lines in culture. These include, but are not limited to, the hybridoma technique, the human B-cell hybridoma technique, and the Epstein-Barr virus (EBV)-hybridoma technique (Kohler et al 1975. Nature 256:4950497; Kozbor et al 1985. J. Immunol. Methods 81:31-42; Cote et al 1983. Proc. Natl. Acad. Sci. USA 80:2026-2030; Cole et al 1984. Mol. Cell. Biol. 62:109-120).

Using these methods it would be routine for the person skilled in the art to prepare antibodies having a binding site with the necessary specificity for the CD137 (4-1BB, TNFRSF9) or Fibroblast Activation Protein (FAP) target antigens. Isolation of the binding domains from such antibodies is a routine practice and indeed further information on methods that can be used are provided in the accompanying examples.

The present inventors prepared specific CD137 (4-1BB, TNFRSF9)/Fibroblast Activation Protein (FAP) immunoglobulin-like binding molecules utilizing the exemplary antigen binding sites for CD137 and FAP of the invention enumerated below, which are discussed in the accompanying examples.

As non-limiting examples, bispecific molecules were prepared using exemplary antigen binding sites specific for CD137 (4-1BB, TNFRSF9), are CD137 #1, CD137 #2, CD137 #3, CD137 #4, CD137 #5, CD137 #6, CD137 #7, CD137 #8, CD137 #9, and CD137 #10.

As non-limiting examples, bispecific molecules were prepared using exemplary using exemplary antigen binding sites specific for Fibroblast Activation Protein (FAP), and termed these FAP #1, FAP #2, FAP #3, FAP #4, and FAP #5.

The amino acid sequences of the specific antigen binding sites are provided in the description and the sequence listing.

Provided below are details of preferred embodiments of the invention which comprise specific binding sites for CD137 (4-1BB, TNFRSF9) or Fibroblast Activation Protein (FAP).

For the avoidance of doubt, each of the specific embodiments listed below for the first aspect of the invention can each also be considered to be independent aspects of the invention.

In a preferred embodiment of the binding molecule of the invention, the antigen binding site specific for CD137 comprises a variable heavy chain region and a variable light chain region, wherein the heavy chain CDRs comprise the amino acid sequences of SEQ ID NO.:290 (CDR1), SEQ ID NO.:8 (CDR2) and SEQ ID NO.:9 (CDR3) and the light chain CDRs comprising the amino acid sequences of SEQ ID NO.:12 (CDR1), SEQ ID NO.:13 (CDR2) and SEQ ID NO.:14 (CDR3). In this embodiment the antigen binding site specific for CD137 is CD137 #1. Preferably the antigen binding site specific for CD137 comprises a variable heavy chain region comprising the amino acid sequence of SEQ ID NO.:10 and a variable light chain region comprising the amino acid sequence of SEQ ID NO.:15. In this embodiment, the antigen binding site specific for CD137 is CD137 #1.

In a preferred embodiment of the binding molecule of the invention, the antigen binding site specific for CD137 comprises a variable heavy chain region and a variable light chain, region wherein the heavy chain CDRs comprise the amino acid sequences of SEQ ID NO.:295 (CDR1), SEQ ID NO.:18 (CDR2) and SEQ ID NO.:9 (CDR3) and the light chain CDRs comprise the amino acid sequences of SEQ ID NO.:22 (CDR1), SEQ ID NO.:23 (CDR2) and SEQ ID NO.:14 (CDR3). In this embodiment the antigen binding site specific for CD137 is CD137 #2.

Preferably the antigen binding site specific for CD137 comprises a variable heavy chain region comprising the amino acid sequence of SEQ ID NO.:20 and a variable light chain region comprising the amino acid sequence of SEQ ID NO.:25. In this embodiment, the antigen binding site specific for CD137 is CD137 #2.

In a preferred embodiment of the binding molecule of the invention, the antigen binding site specific for CD137 comprises a variable heavy chain region and a variable light chain region, wherein the heavy chain CDRs comprise the amino acid sequences of SEQ ID NO.:295 (CDR1), SEQ ID NO.:28 (CDR2) and SEQ ID NO.: 9 (CDR3) and the light chain CDRs comprise the amino acid sequences of SEQ ID NO.:32 (CDR1), SEQ ID NO.33 (CDR2) and SEQ ID NO.:14 (CDR3). In this embodiment, the antigen binding site specific for CD137 is CD137 #3.

Preferably the antigen binding site specific for CD137 comprises a variable heavy chain region comprising the amino acid sequence of SEQ ID NO.:30 and a variable light chain region comprising the amino acid sequence of SEQ ID NO.:35. In this embodiment, the antigen binding site specific for CD137 is CD137 #3.

In a preferred embodiment of the binding molecule of the invention, the antigen binding site specific for CD137 comprises a variable heavy chain region and a variable light chain region, wherein the heavy chain CDRs comprise the amino acid sequences of SEQ ID NO.:295 (CDR1), SEQ ID NO.:38 (CDR2) and SEQ ID NO.:9 (CDR3) and the light chain CDRs comprise the amino acid sequences of SEQ ID NO.:42 (CDR1), SEQ ID NO.:43 (CDR2) and SEQ ID NO.:14 (CDR3). In this embodiment, the antigen binding site specific for CD137 is CD137 #4.

Preferably the antigen binding site specific for CD137 comprises a variable heavy chain region comprising the amino acid sequence of SEQ ID NO.:40 and a variable light chain region comprising the amino acid sequence of SEQ ID NO.:45. In this embodiment, the antigen binding site specific for CD137 is CD137 #4.

In a preferred embodiment of the binding molecule of the invention, the antigen binding site specific for CD137 comprises a variable heavy chain region and a variable light chain region, wherein the heavy chain CDRs comprise the amino acid sequences of SEQ ID NO.:295 (CDR1), SEQ ID NO.:48 (CDR2) and SEQ ID NO.: 9 (CDR3) and the light chain CDRs comprise the amino acid sequences of SEQ ID NO.:52 (CDR1), SEQ ID NO.:53 (CDR2) and SEQ ID NO.:14 (CDR3). In this embodiment, the antigen binding site specific for CD137 is CD137 #5.

Preferably the antigen binding site specific for CD137 comprises a variable heavy chain region comprising the amino acid sequence of SEQ ID NO.:50 and a variable light chain region comprising the amino acid sequence of SEQ ID NO.:55. In this embodiment, the antigen binding site specific for CD137 is CD137 #5.

In a preferred embodiment of the binding molecule of the invention, the antigen binding site specific for CD137 comprises a variable heavy chain region and a variable light chain region, wherein the heavy chain CDRs comprise the amino acid sequences of SEQ ID NO.:295 (CDR1), SEQ ID NO.:58 (CDR2) and SEQ ID NO.:9 (CDR3) and the light chain CDRs comprise the amino acid sequences of SEQ ID NO.:62 (CDR1), SEQ ID NO.:63 (CDR2) and SEQ ID NO.:14 (CDR3). In this embodiment, the antigen binding site specific for CD137 is CD137 #6.

Preferably the antigen binding site specific for CD137 comprises a variable heavy chain region comprising the amino acid sequence of SEQ ID NO.:60 and a variable light chain region comprising the amino acid sequence of SEQ ID NO.:65. In this embodiment, the antigen binding site specific for CD137 is CD137 #6.

In a preferred embodiment of the binding molecule of the invention, the antigen binding site specific for CD137 comprises a variable heavy chain region and a variable light chain region, wherein the heavy chain CDRs comprise the amino acid sequences of SEQ ID NO.:308 (CDR1), SEQ ID NO.:68 (CDR2) and SEQ ID NO.:69 (CDR3) and the light chain CDRs comprise the amino acid sequences of SEQ ID NO.:72 (CDR1), SEQ ID NO.:73 (CDR2) and SEQ ID NO.:74 (CDR3). In this embodiment, the antigen binding site specific for CD137 is CD137 #7.

Preferably the antigen binding site specific for CD137 comprises a variable heavy chain region comprising the amino acid sequence of SEQ ID NO.:70 and a variable light chain region comprising the amino acid sequence of SEQ ID NO.:75. In this embodiment, the antigen binding site specific for CD137 is CD137 #7.

In a preferred embodiment of the binding molecule of the invention, the antigen binding site specific for CD137 comprises a variable heavy chain region and a variable light chain region, wherein the heavy chain CDRs comprise the amino acid sequences of SEQ ID NO.:308 (CDR1), SEQ ID NO.:78 (CDR2) and SEQ ID NO.:69 (CDR3) and the light chain CDRs comprise the amino acid sequences of SEQ ID NO.:72 (CDR1), SEQ ID NO.:73 (CDR2) and SEQ ID NO.:74 (CDR3). In this embodiment, the antigen binding site specific for CD137 is CD137 #8.

Preferably the antigen binding site specific for CD137 comprises a variable heavy chain region comprising the amino acid sequence of SEQ ID NO.:80 and a variable light chain region comprising the amino acid sequence of SEQ ID NO.:85. In this embodiment, the antigen binding site specific for CD137 is CD137 #8.

In a preferred embodiment of the binding molecule of the invention, the antigen binding site specific for CD137 comprises a variable heavy chain region and a variable light chain region, wherein the heavy chain CDRs comprise the amino acid sequences of SEQ ID NO.:308 (CDR1), SEQ ID NO.:88 (CDR2) and SEQ ID NO.:69 (CDR3) and the light chain CDRs comprise the amino acid sequences of SEQ ID NO.:92 (CDR1), SEQ ID NO.:93, (CDR2) and SEQ ID NO.:74 (CDR3). In this embodiment, the antigen binding site specific for CD137 is CD137 #9. Preferably the antigen binding site specific for CD137 comprises a variable heavy chain region comprising the amino acid sequence of SEQ ID NO.:90 and a variable light chain region comprising the amino acid sequence of SEQ ID NO.:95. In this embodiment, the antigen binding site specific for CD137 is CD137 #9. In a preferred embodiment of the binding molecule of the invention, the antigen binding site specific for CD137 comprises a variable heavy chain region and a variable light chain region, wherein the heavy chain CDRs comprise the amino acid sequences of SEQ ID NO.:308 (CDR1), SEQ ID NO.:98 (CDR2) and SEQ ID NO.:69 (CDR3) and the light chain CDRs comprise the amino acid sequences of SEQ ID NO.:92 (CDR1), SEQ ID NO.:93 (CDR2) and SEQ ID NO.:74 (CDR3). In this embodiment, the antigen binding site specific for CD137 is CD137 #10.

Preferably the antigen binding site specific for CD137 comprises a variable heavy chain region comprising the amino acid sequence of SEQ ID NO.:100 and a variable light chain region comprising the amino acid sequence of SEQ ID NO.:105. In this embodiment, the antigen binding site specific for CD137 is CD137 #10.

In a preferred embodiment of the binding molecule of the invention, the antigen binding site specific for FAP comprises a variable heavy chain region and a variable light chain region, wherein the heavy chain CDRs comprise the amino acid sequences of SEQ ID NO.:319 (CDR1), SEQ ID NO.:108 (CDR2) and SEQ ID NO.:109 (CDR3) and the light chain CDRs comprise the amino acid sequences of SEQ ID NO.:111 (CDR1), SEQ ID NO.:112 (CDR2) and SEQ ID NO.:113 (CDR3). In this embodiment, the antigen binding site specific for FAP is FAP #1.

Preferably the antigen binding site specific for FAP comprises a variable heavy chain region comprising the amino acid sequence of SEQ ID NO.:106 and a variable light chain region comprising the amino acid sequence of SEQ ID NO.:110. In this embodiment, the antigen binding site specific for FAP is FAP #1.

In a preferred embodiment of the binding molecule of the invention, the antigen binding site specific for FAP comprises a variable heavy chain region and a variable light chain region, wherein the heavy chain CDRs comprise the amino acid sequences of SEQ ID NO.:319 (CDR1), SEQ ID NO.:117 (CDR2) and SEQ ID NO.:109 (CDR3) and the light chain CDRs comprise the amino acid sequences of SEQ ID NO.:120 (CDR1), SEQ ID NO.:112 (CDR2) and SEQ ID NO.:113 (CDR3). In this embodiment, the antigen binding site specific for FAP is FAP #2.

Preferably the antigen binding site specific for FAP comprises a variable heavy chain region comprising the amino acid sequence of SEQ ID NO.:115 and a variable light chain region comprising the amino acid sequence of SEQ ID NO.:119. In this embodiment, the antigen binding site specific for FAP is FAP #2.

In a preferred embodiment of the binding molecule of the invention, the antigen binding site specific for FAP comprises a variable heavy chain region and a variable light chain region, wherein the heavy chain CDRs comprise the amino acid sequences of SEQ ID NO.:319 (CDR1), SEQ ID NO.:126 (CDR2) and SEQ ID NO.:109 (CDR3) and the light chain CDRs comprise the amino acid sequences of SEQ ID NO.:129 (CDR1), SEQ ID NO.:112 (CDR2) and SEQ ID NO.:113 (CDR3). In this embodiment, the antigen binding site specific for FAP is FAP #3.

Preferably the antigen binding site specific for FAP comprises a variable heavy chain region comprising the amino acid sequence of SEQ ID NO.:124 and a variable light chain region comprising the amino acid sequence of SEQ ID NO.:128. In this embodiment, the antigen binding site specific for FAP is FAP #3.

In a preferred embodiment of the binding molecule of the invention, the antigen binding site specific for FAP comprises a variable heavy chain region and a variable light chain, region wherein the heavy chain CDRs comprise the amino acid sequences of SEQ ID NO.:328 (CDR1), SEQ ID NO.:135 (CDR2) and SEQ ID NO.:136 (CDR3) and the light chain CDRs comprise the amino acid sequences of SEQ ID NO.:138 (CDR1), SEQ ID NO.:139 (CDR2) and SEQ ID NO.:140 (CDR3). In this embodiment, the antigen binding site specific for FAP is FAP #4.

Preferably the antigen binding site specific for FAP comprises a variable heavy chain region comprising the amino acid sequence of SEQ ID NO.:133 and a variable light chain region comprising the amino acid sequence of SEQ ID NO.:137. In this embodiment the antigen binding site specific for FAP is FAP #4.

In a preferred embodiment of the binding molecule of the invention, the antigen binding site specific for FAP comprises a variable heavy chain region and a variable light chain region, wherein the heavy chain CDRs comprise the amino acid sequences of SEQ ID NO.:333 (CDR1), SEQ ID NO.:144 (CDR2) and SEQ ID NO.:145 (CDR3) and the light chain CDRs comprise the amino acid sequences of SEQ ID NO.:138 (CDR1), SEQ ID NO.:139 (CDR2) and SEQ ID NO.:140 (CDR3). In this embodiment, the antigen binding site specific for FAP is FAP #5.

Preferably the antigen binding site specific for FAP comprises a variable heavy chain region comprising the amino acid sequence of SEQ ID NO.:142 and a variable light chain region comprising the amino acid sequence of SEQ ID NO.:146. In this embodiment, the antigen binding site specific for FAP is FAP #5.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:290 (CDR1), SEQ ID NO.:8 (CDR2) and SEQ ID NO.:9 (CDR3) and the light chain CDRs comprise the amino acid sequences of SEQ ID NO.:12 (CDR1), SEQ ID NO.:13 (CDR2) and SEQ ID NO.:14 (CDR3) and the antigen binding site specific for FAP comprises a variable heavy chain region and a variable light chain region wherein the heavy chain CDRs comprise the amino acid sequences of SEQ ID NO.:319 (CDR1), SEQ ID NO.:108 (CDR2) and SEQ ID NO.:109 (CDR3) and the light chain CDRs comprise the amino acid sequences of SEQ ID NO.:111 (CDR1), SEQ ID NO.:112 (CDR2) and SEQ ID NO.:113 (CDR3) In this embodiment, the antigen binding site specific for CD137 is CD137 #1 and the antigen binding site specific for FAP is FAP #1.

Preferably the antigen binding site specific for CD137 comprises a variable heavy chain region comprising the amino acid sequence of SEQ ID NO.:10 and a variable light chain region comprising the amino acid sequence of SEQ ID NO.:15 and the antigen binding site specific for FAP comprises a variable heavy chain region comprising the amino acid sequence of SEQ ID NO.:106 and a variable light chain region comprising the amino acid sequence of SEQ ID NO.:110. In this embodiment, the antigen binding site specific for CD137 is CD137 #1 and the antigen binding site specific for FAP is FAP #1.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:308 (CDR1), SEQ ID NO.:68 (CDR2) and SEQ ID NO.:69 (CDR3) and the light chain CDRs comprise the amino acid sequences of SEQ ID NO.:72 (CDR1), SEQ ID NO.:73 (CDR2) and SEQ ID NO.:74 (CDR3) and the antigen binding site specific for FAP comprises a variable heavy chain region and a variable light chain region wherein the heavy chain CDRs comprise the amino acid sequences of SEQ ID NO.:319 (CDR1), SEQ ID NO.:108 (CDR2) and SEQ ID NO.:109 (CDR3) and has light chain CDRs comprise the amino acid sequences of SEQ ID NO.:111 (CDR1), SEQ ID NO.:112 (CDR2) and SEQ ID NO.:113 (CDR3). In this embodiment the antigen binding site specific for CD137 is CD137 #7 and the antigen binding site specific for FAP is FAP #1.

Preferably the antigen binding site specific for CD137 comprises a variable heavy chain region comprising the amino acid sequence of SEQ ID NO.:70 and a variable light chain region comprising the amino acid sequence of SEQ ID NO.:75 and the antigen binding site specific for FAP comprises a variable heavy chain region comprising the amino acid sequence of SEQ ID NO.:106 and a variable light chain region comprising the amino acid sequence of SEQ ID NO.:110. In this embodiment the antigen binding site specific for CD137 is CD137 #7 and the antigen binding site specific for FAP is FAP #1.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:290 (CDR1), SEQ ID NO.:8 (CDR2) and SEQ ID NO.:9 (CDR3) and the light chain CDRs comprise the amino acid sequences of SEQ ID NO.:12 (CDR1), SEQ ID NO.:13 (CDR2) and SEQ ID NO.:14 (CDR3) and the antigen binding site specific for FAP comprises a variable heavy chain region and a variable light chain region wherein the heavy chain CDRs comprise the amino acid sequences of SEQ ID NO.:328 (CDR1), SEQ ID NO.:135 (CDR2) and SEQ ID NO.:136 (CDR3) and the light chain CDRs comprise the amino acid sequences of SEQ ID NO.:138 (CDR1), SEQ ID NO.:139 (CDR2) and SEQ ID NO.:140 (CDR3). In this embodiment the antigen binding site specific for CD137 is CD137 #1 and the antigen binding site specific for FAP is FAP #4.

Preferably the antigen binding site specific for CD137 comprises a variable heavy chain region comprising the amino acid sequence of SEQ ID NO.:10 and a variable light chain region comprising the amino acid sequence of SEQ ID NO.:15 and the antigen binding site specific for FAP comprises a variable heavy chain region comprising the amino acid sequence of SEQ ID NO.:133 and a variable light chain region comprising the amino acid sequence of SEQ ID NO.:137. In this embodiment the antigen binding site specific for CD137 is CD137 #1 and the antigen binding site specific for FAP is FAP #4.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:308 (CDR1), SEQ ID NO.:68 (CDR2) and SEQ ID NO.:69 (CDR3) and the light chain CDRs comprise the amino acid sequences of SEQ ID NO.:72 (CDR1), SEQ ID NO.:73 (CDR2) and SEQ ID NO.:74 (CDR3) and the antigen binding site specific for FAP comprises a variable heavy chain region and a variable light chain region wherein the heavy chain CDRs comprise the amino acid sequences of SEQ ID NO.:328 (CDR1), SEQ ID NO.:135 (CDR2) and SEQ ID NO.:136 (CDR3) and the light chain CDRs comprise the amino acid sequences of SEQ ID NO.:138 (CDR1), SEQ ID NO.:139 (CDR2) and SEQ ID NO.:140 (CDR3). In this embodiment the antigen binding site specific for CD137 is CD137 #7 and the antigen binding site specific for FAP is FAP #4.

Preferably the antigen binding site specific for CD137 comprises a variable heavy chain region comprising the amino acid sequence of SEQ ID NO.:70 and a variable light chain region comprising the amino acid sequence of SEQ ID NO.:75 and the antigen binding site specific for FAP comprises a variable heavy chain region comprising the amino acid sequence of SEQ ID NO.:133 and a variable light chain region comprising the amino acid sequence of SEQ ID NO.:137. In this embodiment the antigen binding site specific for CD137 is CD137 #7 and the antigen binding site specific for FAP is FAP #4.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:295 (CDR1), SEQ ID NO.:18 (CDR2) and SEQ ID NO.:9 (CDR3) and the light chain CDRs comprise the amino acid sequences of SEQ ID NO.:22 (CDR1), SEQ ID NO.:23 (CDR2) and SEQ ID NO.:14 (CDR3) and the antigen binding site specific for FAP comprises a variable heavy chain region and a variable light chain region wherein the heavy chain CDRs comprise the amino acid sequences of SEQ ID NO.:333 (CDR1), SEQ ID NO.:144 (CDR2) and SEQ ID NO.:145 (CDR3) and the light chain CDRs comprise the amino acid sequences of SEQ ID NO.:138 (CDR1), SEQ ID NO.:139 (CDR2) and SEQ ID NO.:140 (CDR3). In this embodiment, the antigen binding site specific for CD137 is CD137 #2 and the antigen binding site specific for FAP is FAP #5.

Preferably the antigen binding site specific for CD137 comprises a variable heavy chain region comprising the amino acid sequence of SEQ ID NO.:20 and a variable light chain region comprising the amino acid sequence of SEQ ID NO.:25 and the antigen binding site specific for FAP comprises a variable heavy chain region comprising the amino acid sequence of SEQ ID NO.:142 and a variable light chain region comprising the amino acid sequence of SEQ ID NO.:146. In this embodiment the antigen binding site specific for CD137 is CD137 #2 and the antigen binding site specific for FAP is FAP #5.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:295 (CDR1), SEQ ID NO.:18 (CDR2) and SEQ ID NO.:19 (CDR3) and the light chain CDRs comprise the amino acid sequences of SEQ ID NO.:22 (CDR1), SEQ ID NO.:23 (CDR2) and SEQ ID NO.:14 (CDR3) and the antigen binding site specific for FAP comprises a variable heavy chain region and a variable light chain region wherein the heavy chain CDRs comprise the amino acid sequences of SEQ ID NO.:319 (CDR1), SEQ ID NO.:117 (CDR2) and SEQ ID NO.:109 (CDR3) and the light chain CDRs comprise the amino acid sequences of SEQ ID NO.:120 (CDR1), SEQ ID NO.:112 (CDR2) and SEQ ID NO.:113 (CDR3). In this embodiment the antigen binding site specific for CD137 is CD137 #2 and the antigen binding site specific for FAP is FAP #2.

Preferably the antigen binding site specific for CD137 comprises a variable heavy chain region comprising the amino acid sequence of SEQ ID NO.:20 and a variable light chain region comprising the amino acid sequence of SEQ ID NO.:25 and the antigen binding site specific for FAP comprises a variable heavy chain region comprising the amino acid sequence of SEQ ID NO.:115 and a variable light chain region comprising the amino acid sequence of SEQ ID NO.:119. In this embodiment the antigen binding site specific for CD137 is CD137 #2 and the antigen binding site specific for FAP is FAP #2.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:295 (CDR1), SEQ ID NO.:18 (CDR2) and SEQ ID NO.:9 (CDR3) and the light chain CDRs comprise the amino acid sequences of SEQ ID NO.:22 (CDR1), SEQ ID NO.:23 (CDR2) and SEQ ID NO.:14 (CDR3), and the antigen binding site specific for FAP comprises a variable heavy chain region and a variable light chain region wherein the heavy chain CDRs comprise the amino acid sequences of SEQ ID NO.:319 (CDR1), SEQ ID NO.:126 (CDR2) and SEQ ID NO.:109 (CDR3) and the light chain CDRs comprise the amino acid sequences of SEQ ID NO.:129 (CDR1), SEQ ID NO.:112 (CDR2) and SEQ ID NO.:113 (CDR3). In this embodiment the antigen binding site specific for CD137 is CD137 #2 and the antigen binding site specific for FAP is FAP #3.

Preferably the antigen binding site specific for CD137 comprises a variable heavy chain region comprising the amino acid sequence of SEQ ID NO.:30 and a variable light chain region comprising the amino acid sequence of SEQ ID NO.:35 and the antigen binding site specific for FAP comprises a variable heavy chain region comprising the amino acid sequence of SEQ ID NO.:124 and a variable light chain region comprising the amino acid sequence of SEQ ID NO.:128. In this embodiment the antigen binding site specific for CD137 is CD137 #2 and the antigen binding site specific for FAP is FAP #3.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:295 (CDR1), SEQ ID NO.:28 (CDR2) and SEQ ID NO.:9 (CDR3) and the light chain CDRs comprise the amino acid sequences of SEQ ID NO.:32 (CDR1), SEQ ID NO.:33 (CDR2) and SEQ ID NO.:14 (CDR3), and the antigen binding site specific for FAP comprises a variable heavy chain region and a variable light chain region wherein the heavy chain CDRs comprise the amino acid sequences of SEQ ID NO.:333 (CDR1), SEQ ID NO.:144 (CDR2) and SEQ ID NO.:145 (CDR3) and the light chain CDRs comprise the amino acid sequences of SEQ ID NO.:138 (CDR1), SEQ ID NO.:139 (CDR2) and SEQ ID NO.:140 (CDR3). In this embodiment the antigen binding site specific for CD137 is CD137 #3 and the antigen binding site specific for FAP is FAP #5.

Preferably the antigen binding site specific for CD137 comprises a variable heavy chain region comprising the amino acid sequence of SEQ ID NO.:30 and a variable light chain region comprising the amino acid sequence of SEQ ID NO.:35 and the antigen binding site specific for FAP comprises a variable heavy chain region comprising the amino acid sequence of SEQ ID NO.:142 and a variable light chain region comprising the amino acid sequence of SEQ ID NO.:146. In this embodiment the antigen binding site specific for CD137 is CD137 #3 and the antigen binding site specific for FAP is FAP #5.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:295 (CDR1), SEQ ID NO.:28 (CDR2) and SEQ ID NO.:9 (CDR3) and the light chain CDRs comprise the amino acid sequences of SEQ ID NO.:32 (CDR1), SEQ ID NO.:33 (CDR2) and SEQ ID NO.:14 (CDR3) and the antigen binding site specific for FAP comprises a variable heavy chain region and a variable light chain region wherein the heavy chain CDRs comprise the amino acid sequences of SEQ ID NO.:319 (CDR1), SEQ ID NO.:117 (CDR2) and SEQ ID NO.:109 (CDR3) and the light chain CDRs comprise the amino acid sequences of SEQ ID NO.:120 (CDR1), SEQ ID NO.:112 (CDR2) and SEQ ID NO.:113 (CDR3). In this embodiment, the antigen binding site specific for CD137 is CD137 #3 and the antigen binding site specific for FAP is FAP #2.

Preferably the antigen binding site specific for CD137 comprises a variable heavy chain region comprising the amino acid sequence of SEQ ID NO.:30 and a variable light chain region comprising the amino acid sequence of SEQ ID NO.:35 and the antigen binding site specific for FAP comprises a variable heavy chain region comprising the amino acid sequence of SEQ ID NO.:115 and a variable light chain region comprising the amino acid sequence of SEQ ID NO.:119. In this embodiment, the antigen binding site specific for CD137 is CD137 #3 and the antigen binding site specific for FAP is FAP #2.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:295 (CDR1), SEQ ID NO.:28 (CDR2) and SEQ ID NO.:9 (CDR3) and the light chain CDRs comprise the amino acid sequences of SEQ ID NO.:32 (CDR1), SEQ ID NO.:33 (CDR2) and SEQ ID NO.:14 (CDR3) and the antigen binding site specific for FAP comprises a variable heavy chain region and a variable light chain region wherein the heavy chain CDRs comprise the amino acid sequences of SEQ ID NO.:319 (CDR1), SEQ ID NO.:126 (CDR2) and SEQ ID NO.:109 (CDR3) and the light chain CDRs comprise the amino acid sequences of SEQ ID NO.:129 (CDR1), SEQ ID NO.:112 (CDR2) and SEQ ID NO.:113 (CDR3). In this embodiment, the antigen binding site specific for CD137 is CD137 #3 and the antigen binding site specific for FAP is FAP #3.

Preferably the antigen binding site specific for CD137 comprises a variable heavy chain region comprising the amino acid sequence of SEQ ID NO.:30 and a variable light chain region comprising the amino acid sequence of SEQ ID NO.:35. and the antigen binding site specific for FAP comprises a variable heavy chain region comprising the amino acid sequence of SEQ ID NO.:124 and a variable light chain region comprising the amino acid sequence of SEQ ID NO.:128. In this embodiment the antigen binding site specific for CD137 is CD137 #3 and the antigen binding site specific for FAP is FAP #3.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:295 (CDR1), SEQ ID NO.:38 (CDR2) and SEQ ID NO.:9 (CDR3) and the light chain CDRs comprise the amino acid sequences of SEQ ID NO.:42 (CDR1), SEQ ID NO.:43 (CDR2) and SEQ ID NO.:14 (CDR3) and the antigen binding site specific for FAP comprises a variable heavy chain region and a variable light chain region wherein the heavy chain CDRs comprise the amino acid sequences of SEQ ID NO.:333 (CDR1), SEQ ID NO.:144 (CDR2) and SEQ ID NO.:145 (CDR3) and the light chain CDRs comprise the amino acid sequences of SEQ ID NO.:138 (CDR1), SEQ ID NO.:139 (CDR2) and SEQ ID NO.:140 (CDR3). In this embodiment, the antigen binding site specific for CD137 is CD137 #4 and the antigen binding site specific for FAP is FAP #5.

Preferably the antigen binding site specific for CD137 comprises a variable heavy chain region comprising the amino acid sequence of SEQ ID NO.:40 and a variable light chain region comprising the amino acid sequence of SEQ ID NO.:45 and the antigen binding site specific for FAP comprises a variable heavy chain region comprising the amino acid sequence of SEQ ID NO.:142 and a variable light chain region comprising the amino acid sequence of SEQ ID NO.:146. In this embodiment the antigen binding site specific for CD137 is CD137 #4 and the antigen binding site specific for FAP is FAP #5.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:295 (CDR1), SEQ ID NO.:38 (CDR2) and SEQ ID NO.:9 (CDR3) and the light chain CDRs comprise the amino acid sequences of SEQ ID NO.:42 (CDR1), SEQ ID NO.:43 (CDR2) and SEQ ID NO.:14 (CDR3) and the antigen binding site specific for FAP comprises a variable heavy chain region and a variable light chain region wherein the heavy chain CDRs comprise the amino acid sequences of SEQ ID NO.:319 (CDR1), SEQ ID NO.:117 (CDR2) and SEQ ID NO.:109 (CDR3) and the light chain CDRs comprise the amino acid sequences of SEQ ID NO.:120 (CDR1), SEQ ID NO.:112 (CDR2) and SEQ ID NO.:113 (CDR3). In this embodiment the antigen binding site specific for CD137 is CD137 #4 and the antigen binding site specific for FAP is FAP #2.

Preferably the antigen binding site specific for CD137 comprises a variable heavy chain region comprising the amino acid sequence of SEQ ID NO.:40 and a variable light chain region comprising the amino acid sequence of SEQ ID NO.:45 and the antigen binding site specific for FAP comprises a variable heavy chain region comprising the amino acid sequence of SEQ ID NO.:115 and a variable light chain region comprising the amino acid sequence of SEQ ID NO.:119. In this embodiment the antigen binding site specific for CD137 is CD137 #4 and the antigen binding site specific for FAP is FAP #2.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:295 (CDR1), SEQ ID NO.:38 (CDR2) and SEQ ID NO.:9 (CDR3) and the light chain CDRs comprise the amino acid sequences of SEQ ID NO.:42 (CDR1), SEQ ID NO.:43 (CDR2) and SEQ ID NO.:14 (CDR3) and the antigen binding site specific for FAP comprises a variable heavy chain region and a variable light chain region wherein the heavy chain CDRs comprise the amino acid sequences of SEQ ID NO.:319 (CDR1), SEQ ID NO.:126 (CDR2) and SEQ ID NO.:109 (CDR3) and the light chain CDRs comprise the amino acid sequences of SEQ ID NO.:129 (CDR1), SEQ ID NO.:112 (CDR2) and SEQ ID NO.:113 (CDR3). In this embodiment the antigen binding site specific for CD137 is CD137 #4 and the antigen binding site specific for FAP is FAP #3.

Preferably the antigen binding site specific for CD137 comprises a variable heavy chain region comprising the amino acid sequence of SEQ ID NO.:40 and a variable light chain region comprising the amino acid sequence of SEQ ID NO.:45 and the antigen binding site specific for FAP comprises a variable heavy chain region comprising the amino acid sequence of SEQ ID NO.:124 and a variable light chain region comprising the amino acid sequence of SEQ ID NO.:128. In this embodiment the antigen binding site specific for CD137 is CD137 #4 and the antigen binding site specific for FAP is FAP #3.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:295 (CDR1), SEQ ID NO.:48 (CDR2) and SEQ ID NO.:9 (CDR3) and the light chain CDRs comprise the amino acid sequences of SEQ ID NO.:52 (CDR1), SEQ ID NO.:53 (CDR2) and SEQ ID NO.:14 (CDR3) and the antigen binding site specific for FAP comprises a variable heavy chain region and a variable light chain region wherein the heavy chain CDRs comprise the amino acid sequences of SEQ ID NO.:333 (CDR1), SEQ ID NO.:144 (CDR2) and SEQ ID NO.:145 (CDR3) and the light chain CDRs comprise the amino acid sequences of SEQ ID NO.:138 (CDR1), SEQ ID NO.:139 (CDR2) and SEQ ID NO.:140 (CDR3). In this embodiment the antigen binding site specific for CD137 is CD137 #5 and the antigen binding site specific for FAP is FAP #5.

Preferably the antigen binding site specific for CD137 comprises a variable heavy chain region comprising the amino acid sequence of SEQ ID NO.:50 and a variable light chain region comprising the amino acid sequence of SEQ ID NO.:55 and the antigen binding site specific for FAP comprises a variable heavy chain region comprising the amino acid sequence of SEQ ID NO.:142 and a variable light chain region comprising the amino acid sequence of SEQ ID NO.:146. In this embodiment, the antigen binding site specific for CD137 is CD137 #5 and the antigen binding site specific for FAP is FAP #5.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:295 (CDR1), SEQ ID NO.:48 (CDR2) and SEQ ID NO.:9 (CDR3) and the light chain CDRs comprise the amino acid sequences of SEQ ID NO.:52 (CDR1), SEQ ID NO.:53 (CDR2) and SEQ ID NO.:14 (CDR3) and the antigen binding site specific for FAP comprises a variable heavy chain region and a variable light chain region wherein the heavy chain CDRs comprise the amino acid sequences of SEQ ID NO.:319 (CDR1), SEQ ID NO.:117 (CDR2) and SEQ ID NO.:109 (CDR3) and the light chain CDRs comprise the amino acid sequences of SEQ ID NO.:120 (CDR1), SEQ ID NO.:112 (CDR2) and SEQ ID NO.:113 (CDR3). In this embodiment the antigen binding site specific for CD137 is CD137 #5 and the antigen binding site specific for FAP is FAP #2.

Preferably the antigen binding site specific for CD137 comprises a variable heavy chain region comprising the amino acid sequence of SEQ ID NO.:50 and a variable light chain region comprising the amino acid sequence of SEQ ID NO.:55 and the antigen binding site specific for FAP comprises a variable heavy chain region comprising the amino acid sequence of SEQ ID NO.:115 and a variable light chain region comprising the amino acid sequence of SEQ ID NO.:119. In this embodiment the antigen binding site specific for CD137 is CD137 #5 and the antigen binding site specific for FAP is FAP #2.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:295 (CDR1), SEQ ID NO.:48 (CDR2) and SEQ ID NO.:9 (CDR3) and the light chain CDRs comprise the amino acid sequences of SEQ ID NO.:52 (CDR1), SEQ ID NO.:53 (CDR2) and SEQ ID NO.:14 (CDR3) and the antigen binding site specific for FAP comprises a variable heavy chain region and a variable light chain region wherein the heavy chain CDRs comprise the amino acid sequences of SEQ ID NO.:319 (CDR1), SEQ ID NO.:126 (CDR2) and SEQ ID NO.:109 (CDR3) and the light chain CDRs comprise the amino acid sequences of SEQ ID NO.:129 (CDR1), SEQ ID NO.:112 (CDR2) and SEQ ID NO.:113 (CDR3). In this embodiment the antigen binding site specific for CD137 is CD137 #5 and the antigen binding site specific for FAP is FAP #3.

Preferably the antigen binding site specific for CD137 comprises a variable heavy chain region comprising the amino acid sequence of SEQ ID NO.:50 and a variable light chain region comprising the amino acid sequence of SEQ ID NO.:55 and the antigen binding site specific for FAP comprises a variable heavy chain region comprising the amino acid sequence of SEQ ID NO.:124 and a variable light chain region comprising the amino acid sequence of SEQ ID NO.:128. In this embodiment the antigen binding site specific for CD137 is CD137 #5 and the antigen binding site specific for FAP is FAP #3.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:295 (CDR1), SEQ ID NO.:58 (CDR2) and SEQ ID NO.:9 (CDR3) and the light chain CDRs comprise the amino acid sequences of SEQ ID NO.:62 (CDR1), SEQ ID NO.:63 (CDR2) and SEQ ID NO.:14 (CDR3) and the antigen binding site specific for FAP comprises a variable heavy chain region and a variable light chain region wherein the heavy chain CDRs comprise the amino acid sequences of SEQ ID NO.:333 (CDR1), SEQ ID NO.:144 (CDR2) and SEQ ID NO.:145 (CDR3) and the light chain CDRs comprise the amino acid sequences of SEQ ID NO.:138 (CDR1), SEQ ID NO.:139 (CDR2) and SEQ ID NO.:140 (CDR3). In this embodiment, the antigen binding site specific for CD137 is CD137 #6 and the antigen binding site specific for FAP is FAP #5.

Preferably the antigen binding site specific for CD137 comprises a variable heavy chain region comprising the amino acid sequence of SEQ ID NO.:60 and a variable light chain region comprising the amino acid sequence of SEQ ID NO.:65 and the antigen binding site specific for FAP comprises a variable heavy chain region comprising the amino acid sequence of SEQ ID NO.:142 and a variable light chain region comprising the amino acid sequence of SEQ ID NO.:146. In this embodiment, the antigen binding site specific for CD137 is CD137 #6 and the antigen binding site specific for FAP is FAP #5.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:295 (CDR1), SEQ ID NO.:58 (CDR2) and SEQ ID NO.:9 (CDR3) and the light chain CDRs comprise the amino acid sequences of SEQ ID NO.:62 (CDR1), SEQ ID NO.:63 (CDR2) and SEQ ID NO.:14 (CDR3) and the antigen binding site specific for FAP comprises a variable heavy chain region and a variable light chain region wherein the heavy chain CDRs comprise the amino acid sequences of SEQ ID NO.:319 (CDR1), SEQ ID NO.:117 (CDR2) and SEQ ID NO.:109 (CDR3) and the light chain CDRs comprise the amino acid sequences of SEQ ID NO.:120 (CDR1), SEQ ID NO.:112 (CDR2) and SEQ ID NO.:113 (CDR3). In this embodiment the antigen binding site specific for CD137 is CD137 #6 and the antigen binding site specific for FAP is FAP #2.

Preferably the antigen binding site specific for CD137 comprises a variable heavy chain region comprising the amino acid sequence of SEQ ID NO.:60 and a variable light chain region comprising the amino acid sequence of SEQ ID NO.:65 and the antigen binding site specific for FAP comprises a variable heavy chain region comprising the amino acid sequence of SEQ ID NO.:115 and a variable light chain region comprising the amino acid sequence of SEQ ID NO.:119. In this embodiment, the antigen binding site specific for CD137 is CD137 #6 and the antigen binding site specific for FAP is FAP #2.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:295 (CDR1), SEQ ID NO.:58 (CDR2) and SEQ ID NO.:9 (CDR3) and the light chain CDRs comprise the amino acid sequences of SEQ ID NO.:62 (CDR1), SEQ ID NO.:63 (CDR2) and SEQ ID NO.:14 (CDR3) and the antigen binding site specific for FAP comprises a variable heavy chain region and a variable light chain region wherein the heavy chain CDRs comprise the amino acid sequences of SEQ ID NO.:319 (CDR1), SEQ ID NO.:126 (CDR2) and SEQ ID NO.:109 (CDR3) and the light chain CDRs comprise the amino acid sequences of SEQ ID NO.:129 (CDR1), SEQ ID NO.:112 (CDR2) and SEQ ID NO.:113 (CDR3). In this embodiment the antigen binding site specific for CD137 is CD137 #6 and the antigen binding site specific for FAP is FAP #3.

Preferably the antigen binding site specific for CD137 comprises a variable heavy chain region comprising the amino acid sequence of SEQ ID NO.:60 and a variable light chain region comprising the amino acid sequence of SEQ ID NO.:64 and the antigen binding site specific for FAP comprises a variable heavy chain region comprising the amino acid sequence of SEQ ID NO.:124 and a variable light chain region comprising the amino acid sequence of SEQ ID NO.:128. In this embodiment the antigen binding site specific for CD137 is CD137 #6 and the antigen binding site specific for FAP is FAP #3.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:308 (CDR1), SEQ ID NO.:78 (CDR2) and SEQ ID NO.:69 (CDR3) and the light chain CDRs comprise the amino acid sequences of SEQ ID NO.:72 (CDR1), SEQ ID NO.:73 (CDR2) and SEQ ID NO.:74 (CDR3) and the antigen binding site specific for FAP comprises a variable heavy chain region and a variable light chain region wherein the heavy chain CDRs comprise the amino acid sequences of SEQ ID NO.:333 (CDR1), SEQ ID NO.:144 (CDR2) and SEQ ID NO.:145 (CDR3) and the light chain CDRs comprise the amino acid sequences of SEQ ID NO.:138 (CDR1), SEQ ID NO.:139 (CDR2) and SEQ ID NO.:140 (CDR3). In this embodiment the antigen binding site specific for CD137 is CD137 #8 and the antigen binding site specific for FAP is FAP #5.

Preferably the antigen binding site specific for CD137 comprises a variable heavy chain region comprising the amino acid sequence of SEQ ID NO.:80 and a variable light chain region comprising the amino acid sequence of SEQ ID NO.:85 and the antigen binding site specific for FAP comprises a variable heavy chain region comprising the amino acid sequence of SEQ ID NO.:142 and a variable light chain region comprising the amino acid sequence of SEQ ID NO.:146. In this embodiment the antigen binding site specific for CD137 is CD137 #8 and the antigen binding site specific for FAP is FAP #5.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:308 (CDR1), SEQ NO.:78 (CDR2) and SEQ ID NO.:69 (CDR3) and the light chain CDRs comprise the amino acid sequences of SEQ ID NO.:72 (CDR1), SEQ ID NO.:73 (CDR2) and SEQ ID NO.:74 (CDR3) and the antigen binding site specific for FAP comprises a variable heavy chain region and a variable light chain region wherein the heavy chain CDRs comprise the amino acid sequences of SEQ ID NO.:319 (CDR1), SEQ ID NO.:117 (CDR2) and SEQ ID NO.:109 (CDR3) and the light chain CDRs comprise the amino acid sequences of SEQ ID NO.:120 (CDR1), SEQ ID NO.:112 (CDR2) and SEQ ID NO.:113 (CDR3). In this embodiment the antigen binding site specific for CD137 is CD137 #8 and the antigen binding site specific for FAP is FAP #2.

Preferably the antigen binding site specific for CD137 comprises a variable heavy chain region comprising the amino acid sequence of SEQ ID NO.:80 and a variable light chain region comprising the amino acid sequence of SEQ ID NO.:85 and the antigen binding site specific for FAP comprises a variable heavy chain region comprising the amino acid sequence of SEQ ID NO.:115 and a variable light chain region comprising the amino acid sequence of SEQ ID NO.:119. In this embodiment the antigen binding site specific for CD137 is CD137 #8 and the antigen binding site specific for FAP is FAP #2.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:308 (CDR1), SEQ ID NO.:78 (CDR2) and SEQ ID NO.:69 (CDR3) and the light chain CDRs comprise the amino acid sequences of SEQ ID NO.:72 (CDR1), SEQ ID NO.:73 (CDR2) and SEQ ID NO.:74 (CDR3) and the antigen binding site specific for FAP comprises a variable heavy chain region and a variable light chain region wherein the heavy chain CDRs comprise the amino acid sequences of SEQ ID NO.:319 (CDR1), SEQ ID NO.:126 (CDR2) and SEQ ID NO.:109 (CDR3) and the light chain CDRs comprise the amino acid sequences of SEQ ID NO.:129 (CDR1), SEQ ID NO.:112 (CDR2) and SEQ ID NO.:113 (CDR3). In this embodiment the antigen binding site specific for CD137 is CD137 #8 and the antigen binding site specific for FAP is FAP #3.

Preferably the antigen binding site specific for CD137 comprises a variable heavy chain region comprising the amino acid sequence of SEQ ID NO.:80 and a variable light chain region comprising the amino acid sequence of SEQ ID NO.:85 and the antigen binding site specific for FAP comprises a variable heavy chain region comprising the amino acid sequence of SEQ ID NO.:124 and a variable light chain region comprising the amino acid sequence of SEQ ID NO.:128. In this embodiment the antigen binding site specific for CD137 is CD137 #8 and the antigen binding site specific for FAP is FAP #3.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:308 (CDR1), SEQ ID NO.:88 (CDR2) and SEQ ID NO.:69 (CDR3) and the light chain CDRs comprise the amino acid sequences of SEQ ID NO.:92 (CDR1), SEQ ID NO.:93 (CDR2) and SEQ ID NO.:74 (CDR3) and the antigen binding site specific for FAP comprises a variable heavy chain region and a variable light chain region wherein the heavy chain CDRs comprise the amino acid sequences of SEQ ID NO.:333 (CDR1), SEQ ID NO.:144 (CDR2) and SEQ ID NO.:145 (CDR3) and the light chain CDRs comprise the amino acid sequences of SEQ ID NO.:138 (CDR1), SEQ ID NO.:139 (CDR2) and SEQ ID NO.:140 (CDR3). In this embodiment, the antigen binding site specific for CD137 is CD137 #9 and the antigen binding site specific for FAP is FAP #5.

Preferably the antigen binding site specific for CD137 comprises a variable heavy chain region comprising the amino acid sequence of SEQ ID NO.:90 and a variable light chain region comprising the amino acid sequence of SEQ ID NO.:95 and the antigen binding site specific for FAP comprises a variable heavy chain region comprising the amino acid sequence of SEQ ID NO.:142 and a variable light chain region comprising the amino acid sequence of SEQ ID NO.:146. In this embodiment the antigen binding site specific for CD137 is CD137 #9 and the antigen binding site specific for FAP is FAP #5.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:308 (CDR1), SEQ ID NO.:88 (CDR2) and SEQ ID NO.:69 (CDR3) and the light chain CDRs comprise the amino acid sequences of SEQ ID NO.:92 (CDR1), SEQ ID NO.:93 (CDR2) and SEQ ID NO.:74 (CDR3) and the antigen binding site specific for FAP comprises a variable heavy chain region and a variable light chain region wherein the heavy chain CDRs comprise the amino acid sequences of SEQ ID NO.:319 (CDR1), SEQ ID NO.:117 (CDR2) and SEQ ID NO.:109 (CDR3) and the light chain CDRs comprise the amino acid sequences of SEQ ID NO.:120 (CDR1), SEQ ID NO.:112 (CDR2) and SEQ ID NO.:113 (CDR3). In this embodiment the antigen binding site specific for CD137 is CD137 #9 and the antigen binding site specific for FAP is FAP #2.

Preferably the antigen binding site specific for CD137 comprises a variable heavy chain region comprising the amino acid sequence of SEQ ID NO.:90 and a variable light chain region comprising the amino acid sequence of SEQ ID NO.:95 and the antigen binding site specific for FAP comprises a variable heavy chain region comprising the amino acid sequence of SEQ ID NO.:115 and a variable light chain region comprising the amino acid sequence of SEQ ID NO.:119. In this embodiment the antigen binding site specific for CD137 is CD137 #9 and the antigen binding site specific for FAP is FAP #2.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:308 (CDR1), SEQ ID NO.:88 (CDR2) and SEQ ID NO.:69 (CDR3) and the light chain CDRs comprise the amino acid sequences of SEQ ID NO.:92 (CDR1), SEQ ID NO.:93 (CDR2) and SEQ ID NO.:74 (CDR3) and the antigen binding site specific for FAP comprises a variable heavy chain region and a variable light chain region wherein the heavy chain CDRs comprise the amino acid sequences of SEQ ID NO.:319 (CDR1), SEQ ID NO.:126 (CDR2) and SEQ ID NO.:109 (CDR3) and the light chain CDRs comprise the amino acid sequences of SEQ ID NO.:129 (CDR1), SEQ ID NO.:112 (CDR2) and SEQ ID NO.:113 (CDR3). In this embodiment the antigen binding site specific for CD137 is CD137 #9 and the antigen binding site specific for FAP is FAP #3.

Preferably the antigen binding site specific for CD137 comprises a variable heavy chain region comprising the amino acid sequence of SEQ ID NO.:90 and a variable light chain region comprising the amino acid sequence of SEQ ID NO.:95 and the antigen binding site specific for FAP comprises a variable heavy chain region comprising the amino acid sequence of SEQ ID NO.:124 and a variable light chain region comprising the amino acid sequence of SEQ ID NO.:128. In this embodiment the antigen binding site specific for CD137 is CD137 #9 and the antigen binding site specific for FAP is FAP #3.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:308 (CDR1), SEQ ID NO.:98 (CDR2) and SEQ ID NO.:69 (CDR3) and the light chain CDRs comprise the amino acid sequences of SEQ ID NO.:92 (CDR1), SEQ ID NO.:93 (CDR2) and SEQ ID NO.:74 (CDR3) and the antigen binding site specific for FAP comprises a variable heavy chain region and a variable light chain region wherein the heavy chain CDRs comprise the amino acid sequences of SEQ ID NO.:333 (CDR1), SEQ ID NO.:144 (CDR2) and SEQ ID NO.:145 (CDR3) and the light chain CDRs comprise the amino acid sequences of SEQ ID NO.:138 (CDR1), SEQ ID NO.:139 (CDR2) and SEQ ID NO.:140 (CDR3). In this embodiment the antigen binding site specific for CD137 is CD137 #10 and the antigen binding site specific for FAP is FAP #5.

Preferably the antigen binding site specific for CD137 comprises a variable heavy chain region comprising the amino acid sequence of SEQ ID NO.:100 and a variable light chain region comprising the amino acid sequence of SEQ ID NO.:105 and the antigen binding site specific for FAP comprises a variable heavy chain region comprising the amino acid sequence of SEQ ID NO.:142 and a variable light chain region comprising the amino acid sequence of SEQ ID NO.:146. In this embodiment the antigen binding site specific for CD137 is CD137 #10 and the antigen binding site specific for FAP is FAP #5.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:308 (CDR1), SEQ ID NO.:98 (CDR2) and SEQ ID NO.:69 (CDR3) and the light chain CDRs comprise the amino acid sequences of SEQ ID NO.:92 (CDR1), SEQ ID NO.:93 (CDR2) and SEQ ID NO.:74 (CDR3) and the antigen binding site specific for FAP comprises a variable heavy chain region and a variable light chain region wherein the heavy chain CDRs comprise the amino acid sequences of SEQ ID NO.:319 (CDR1), SEQ ID NO.:117 (CDR2) and SEQ ID NO.:109 (CDR3) and the light chain CDRs comprise the amino acid sequences of SEQ ID NO.:120 (CDR1), SEQ ID NO.:112 (CDR2) and SEQ ID NO.:113 (CDR3). In this embodiment the antigen binding site specific for CD137 is CD137 #10 and the antigen binding site specific for FAP is FAP #2.

Preferably the antigen binding site specific for CD137 comprises a variable heavy chain region comprising the amino acid sequence of SEQ ID NO.:100 and a variable light chain region comprising the amino acid sequence of SEQ ID NO.:105 and the antigen binding site specific for FAP comprises a variable heavy chain region comprising the amino acid sequence of SEQ ID NO.:115 and a variable light chain region comprising the amino acid sequence of SEQ ID NO.:119. In this embodiment the antigen binding site specific for CD137 is CD137 #10 and the antigen binding site specific for FAP is FAP #2.

In a preferred embodiment of the binding molecule of the invention, the antigen binding site specific for CD137 comprises a variable heavy chain region and a variable light chain region wherein the heavy chain CDRs comprise the amino acid sequences of SEQ ID NO.:308 (CDR1), SEQ ID NO.:98 (CDR2) and SEQ ID NO.:69 (CDR3) and the light chain CDRs comprise the amino acid sequences of SEQ ID NO.:92 (CDR1), SEQ ID NO.:93 (CDR2) and SEQ ID NO.:74 (CDR3) and the antigen binding site specific for FAP comprises a variable heavy chain region and a variable light chain region wherein the heavy chain CDRs comprise the amino acid sequences of SEQ ID NO.:319 (CDR1), SEQ ID NO.:126 (CDR2) and SEQ ID NO.:109 (CDR3) and the light chain CDRs comprise the amino acid sequences of SEQ ID NO.:129 (CDR1), SEQ ID NO.:112 (CDR2) and SEQ ID NO.:113 (CDR3). In this embodiment the antigen binding site specific for CD137 is CD137 #10 and the antigen binding site specific for FAP is FAP #3.

Preferably the antigen binding site specific for CD137 comprises a variable heavy chain region comprising the amino acid sequence of SEQ ID NO.:100 and a variable light chain region comprising the amino acid sequence of SEQ ID NO.:105 and the antigen binding site specific for FAP comprises a variable heavy chain region comprising the amino acid sequence of SEQ ID NO.:124 and a variable light chain region comprising the amino acid sequence of SEQ ID NO.:128. In this embodiment the antigen binding site specific for CD137 is CD137 #10 and the antigen binding site specific for FAP is FAP #3. Set out above are specific combinations of the antigen binding sites specific for CD137 and FAP that can be used in the binding molecule of the invention.

In each of these embodiments, the variable heavy chain containing the antigen binding site CD137 is fused to a human heavy chain constant region. For example, IgG, IgG2, IgG3, IgG4, IgA, IgE or IgM. Preferably the heavy chain constant region of human IgG1 is used.

A further embodiment of the invention is wherein the variable light chain containing the antigen binding site CD137 is fused to the human light chain constant region kappa or lambda. Preferably the light chain constant region of human kappa is used.

Example sequences for heavy chain constant region of human IgG1 wild type is provided in SEQ ID NO.: 283, IgG1 KO is provided in SEQ ID NO.:284.

Example sequence for light chain constant region of human kappa provided in SEQ ID NO.:285.

Provided below are binding molecules of the invention. Each of the specific molecules of the invention comprise modified immunoglobulin molecules in which the immunoglobulin heavy chain comprises an amino acid sequence of a variable heavy domain which binds specifically to CD137 and also an scFv which binds specifically to FAP, and an antibody light chain which comprises the amino acid sequence of a variable light domain which binds specifically to CD137.

A further aspect of the invention provides an immunoglobulin-like binding molecule comprising an immunoglobulin heavy chain fused to a scFv at its C-terminus comprising the amino acid sequence of SEQ ID NO.:151 and a light chain comprising the amino acid sequence of SEQ ID NO.:152. In this aspect the antigen binding site specific for CD137 is CD137 #1 and the antigen binding site specific for FAP is FAP #1.

A further aspect of the invention provides an immunoglobulin-like binding molecule comprising an immunoglobulin heavy chain fused to a scFv at its C-terminus comprising the amino acid sequence of SEQ ID NO.:153 and a light chain comprising the amino acid sequence of SEQ ID NO.:154. In this aspect the antigen binding site specific for CD137 is CD137 #7 and the antigen binding site specific for FAP is FAP #1.

A further aspect of the invention provides an immunoglobulin-like binding molecule comprising an immunoglobulin heavy chain fused to a scFv at its C-terminus comprising the amino acid sequence of SEQ ID NO.:155 and a light chain comprising the amino acid sequence of SEQ ID NO.:156. In this aspect the antigen binding site specific for CD137 is CD137 #1 and the antigen binding site specific for FAP is FAP #4.

A further aspect of the invention provides an immunoglobulin-like binding molecule comprising an immunoglobulin heavy chain fused to a scFv at its C-terminus comprising the amino acid sequence of SEQ ID NO.:157 and a light chain comprising the amino acid sequence of SEQ ID NO.:158. In this aspect the antigen binding site specific for CD137 is CD137 #7 and the antigen binding site specific for FAP is FAP #4.

A further aspect of the invention provides an immunoglobulin-like binding molecule comprising an immunoglobulin heavy chain fused to a scFv at its C-terminus comprising the amino acid sequence of SEQ ID NO.:159 and a light chain comprising the amino acid sequence of SEQ ID NO.:160. In this aspect the antigen binding site specific for CD137 is CD137 #2 and the antigen binding site specific for FAP is FAP #5.

A further aspect of the invention provides an immunoglobulin-like binding molecule comprising an immunoglobulin heavy chain fused to a scFv at its C-terminus comprising the amino acid sequence of SEQ ID NO.:164 and a light chain comprising the amino acid sequence of SEQ ID NO.:165. In this aspect the antigen binding site specific for CD137 is CD137 #2 and the antigen binding site specific for FAP is FAP #2.

A further aspect of the invention provides an immunoglobulin-like binding molecule comprising an immunoglobulin heavy chain fused to a scFv at its C-terminus comprising the amino acid sequence of SEQ ID NO.:169 and a light chain comprising the amino acid sequence of SEQ ID NO.:170. In this aspect the antigen binding site specific for CD137 is CD137 #2 and the antigen binding site specific for FAP is FAP #3.

A further aspect of the invention provides an immunoglobulin-like binding molecule comprising an immunoglobulin heavy chain fused to a scFv at its C-terminus comprising the amino acid sequence of SEQ ID NO.:174 and a light chain comprising the amino acid sequence of SEQ ID NO.:175. In this aspect the antigen binding site specific for CD137 is CD137 #3 and the antigen binding site specific for FAP is FAP #5.

A further aspect of the invention provides an immunoglobulin-like binding molecule comprising an immunoglobulin heavy chain fused to a scFv at its C-terminus comprising the amino acid sequence of SEQ ID NO.:179 and a light chain comprising the amino acid sequence of SEQ ID NO.:180. In this aspect the antigen binding site specific for CD137 is CD137 #3 and the antigen binding site specific for FAP is FAP #2.

A further aspect of the invention provides an immunoglobulin-like binding molecule comprising an immunoglobulin heavy chain fused to a scFv at its C-terminus comprising the amino acid sequence of SEQ ID NO.:184 and a light chain comprising the amino acid sequence of SEQ ID NO.:185. In this aspect the antigen binding site specific for CD137 is CD137 #3 and the antigen binding site specific for FAP is FAP #3.

A further aspect of the invention provides an immunoglobulin-like binding molecule comprising an immunoglobulin heavy chain fused to a scFv at its C-terminus comprising the amino acid sequence of SEQ ID NO.:189 and a light chain comprising the amino acid sequence of SEQ ID NO.:190. In this aspect the antigen binding site specific for CD137 is CD137 #4 and the antigen binding site specific for FAP is FAP #5.

A further aspect of the invention provides an immunoglobulin-like binding molecule comprising an immunoglobulin heavy chain fused to a scFv at its C-terminus comprising the amino acid sequence of SEQ ID NO.:194 and a light chain comprising the amino acid sequence of SEQ ID NO.:195. In this aspect the antigen binding site specific for CD137 is CD137 #4 and the antigen binding site specific for FAP is FAP #2.

A further aspect of the invention provides an immunoglobulin-like binding molecule comprising an immunoglobulin heavy chain fused to a scFv at its C-terminus comprising the amino acid sequence of SEQ ID NO.:199 and a light chain comprising the amino acid sequence of SEQ ID NO.:200. In this aspect the antigen binding site specific for CD137 is CD137 #4 and the antigen binding site specific for FAP is FAP #3.

A further aspect of the invention provides an immunoglobulin-like binding molecule comprising an immunoglobulin heavy chain fused to a scFv at its C-terminus comprising the amino acid sequence of SEQ ID NO.:204 and a light chain comprising the amino acid sequence of SEQ ID NO.:205. In this aspect the antigen binding site specific for CD137 is CD137 #5 and the antigen binding site specific for FAP is FAP #5.

A further aspect of the invention provides an immunoglobulin-like binding molecule comprising an immunoglobulin heavy chain fused to a scFv at its C-terminus comprising the amino acid sequence of SEQ ID NO.:209 and a light chain comprising the amino acid sequence of SEQ ID NO.:210. In this aspect the antigen binding site specific for CD137 is CD137 #5 and the antigen binding site specific for FAP is FAP #2.

A further aspect of the invention provides an immunoglobulin-like binding molecule comprising an immunoglobulin heavy chain fused to a scFv at its C-terminus comprising the amino acid sequence of SEQ ID NO.:214 and a light chain comprising the amino acid sequence of SEQ ID NO.:215. In this aspect the antigen binding site specific for CD137 is CD137 #5 and the antigen binding site specific for FAP is FAP #3.

A further aspect of the invention provides an immunoglobulin-like binding molecule comprising an immunoglobulin heavy chain fused to a scFv at its C-terminus comprising the amino acid sequence of SEQ ID NO.:219 and a light chain comprising the amino acid sequence of SEQ ID NO.:220. In this aspect the antigen binding site specific for CD137 is CD137 #6 and the antigen binding site specific for FAP is FAP #5.

A further aspect of the invention provides an immunoglobulin-like binding molecule comprising an immunoglobulin heavy chain fused to a scFv at its C-terminus comprising the amino acid sequence of SEQ ID NO.:224 and a light chain comprising the amino acid sequence of SEQ ID NO.:225. In this aspect the antigen binding site specific for CD137 is CD137 #6 and the antigen binding site specific for FAP is FAP #2.

A further aspect of the invention provides an immunoglobulin-like binding molecule comprising an immunoglobulin heavy chain fused to a scFv at its C-terminus comprising the amino acid sequence of SEQ ID NO.:229 and a light chain comprising the amino acid sequence of SEQ ID NO.:230. In this aspect the antigen binding site specific for CD137 is CD137 #6 and the antigen binding site specific for FAP is FAP #3.

A further aspect of the invention provides an immunoglobulin-like binding molecule comprising an immunoglobulin heavy chain fused to a scFv at its C-terminus comprising the amino acid sequence of SEQ ID NO.:234 and a light chain comprising the amino acid sequence of SEQ ID NO.:235. In this aspect the antigen binding site specific for CD137 is CD137 #8 and the antigen binding site specific for FAP is FAP #5.

A further aspect of the invention provides an immunoglobulin-like binding molecule comprising an immunoglobulin heavy chain fused to a scFv at its C-terminus comprising the amino acid sequence of SEQ ID NO.:239 and a light chain comprising the amino acid sequence of SEQ ID NO.:240. In this aspect the antigen binding site specific for CD137 is CD137 #8 and the antigen binding site specific for FAP is FAP #2.

A further aspect of the invention provides an immunoglobulin-like binding molecule comprising an immunoglobulin heavy chain fused to a scFv at its C-terminus a heavy chain comprising the amino acid sequence of SEQ ID NO.:244 and a light chain comprising the amino acid sequence of SEQ ID NO.:245. In this aspect the antigen binding site specific for CD137 is CD137 #8 and the antigen binding site specific for FAP is FAP #3.

A further aspect of the invention provides an immunoglobulin-like binding molecule comprising an immunoglobulin heavy chain fused to a scFv at its C-terminus comprising the amino acid sequence of SEQ ID NO.:249 and a light chain comprising the amino acid sequence of SEQ ID NO.:250. In this aspect the antigen binding site specific for CD137 is CD137 #9 and the antigen binding site specific for FAP is #5.

A further aspect of the invention provides a an immunoglobulin-like binding molecule comprising an immunoglobulin heavy chain fused to a scFv at its C-terminus comprising the amino acid sequence of SEQ ID NO.:254 and a light chain comprising the amino acid sequence of SEQ ID NO.:255. In this aspect the antigen binding site specific for CD137 is CD137 #9 and the antigen binding site specific for FAP is FAP #2.

A further aspect of the invention provides an immunoglobulin-like binding molecule comprising an immunoglobulin heavy chain fused to a scFv at its C-terminus comprising the amino acid sequence of SEQ ID NO.:259 and a light chain comprising the amino acid sequence of SEQ ID NO.:260. In this aspect the antigen binding site specific for CD137 is CD137 #9 and the antigen binding site specific for FAP is FAP #3.

A further aspect of the invention provides an immunoglobulin-like binding molecule comprising an immunoglobulin heavy chain fused to a scFv at its C-terminus comprising the amino acid sequence of SEQ ID NO.:264 and a light chain comprising the amino acid sequence of SEQ ID NO.:265. In this aspect the antigen binding site specific for CD137 is CD137 #10 and the antigen binding site specific for FAP is FAP #5.

A further aspect of the invention provides an immunoglobulin-like binding molecule comprising an immunoglobulin heavy chain fused to a scFv at its C-terminus comprising the amino acid sequence of SEQ ID NO.:269 and a light chain comprising the amino acid sequence of SEQ ID NO.:270. In this aspect the antigen binding site specific for CD137 is CD137 #10 and the antigen binding site specific for FAP is FAP #2.

A further aspect of the invention provides an immunoglobulin-like binding molecule comprising an immunoglobulin heavy chain fused to a scFv at its C-terminus comprising the amino acid sequence of SEQ ID NO.:274 and a light chain comprising the amino acid sequence of SEQ ID NO.:275. In this aspect the antigen binding site specific for CD137 is CD137 #10 and the antigen binding site specific for FAP is FAP #3.

A further aspect of the invention provides nucleic acid molecules that encode the binding molecule of the invention or an expression vector containing such a nucleic acid molecule.

In some embodiments, the binding molecules of the invention comprise antibody heavy chain and light chain polypeptides. As can be appreciated by the skilled person, nucleic acid molecules can be readily prepared which encode the heavy chain polypeptides, light chain polypeptides, or heavy chain polypeptides and light chain polypeptides.

Nucleic acid molecules coding for the light chain and the heavy chain may be synthesized chemically and enzymatically by Polymerase Chain Reaction (PCR) using standard methods. First, suitable oligonucleotides can be synthesized with methods known in the art (e.g. Gait, 1984), which can be used to produce a synthetic gene. Methods to generate synthetic genes from oligonucleotides are known in the art (e.g. Stemmer et al., 1995; Ye et al., 1992; Hayden and Mandecki, 1988; Frank et al., 1987).

The nucleic acid molecules of the invention include, but are not limited to, the DNA molecules encoding the polypeptide sequences shown in the sequence listing. Also, the present invention also relates to nucleic acid molecules that hybridize to the DNA molecules encoding the polypeptide sequences shown in the sequence listing under high stringency binding and washing conditions, as defined in WO 2007/042309. Preferred molecules (from an mRNA perspective) are those that have at least 75% or 80% (preferably at least 85%, more preferably at least 90% and most preferably at least 95%) homology or sequence identity with one of the DNA molecules described herein. By way of example, in view of expressing the antibodies in eukaryotic cells, the DNA sequences shown in the sequence listing have been designed to match codon usage in eukaryotic cells. If it is desired to express the antibodies in *E. coli*, these sequences can be changed to match *E. coli* codon usage. Variants of DNA molecules of the invention can be constructed in several different ways, as described e.g. in WO 2007/042309.

As used herein, the terms "identical" or "percent identity," in the context of two or more nucleic acids or polypeptide sequences, refer to two or more sequences or subsequences that are the same or have a specified percentage of nucleotides or amino acid residues that are the same, when compared and aligned for maximum correspondence. To determine the percent identity, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences (i.e., % identity=# of identical positions/total # of positions (e.g., overlapping positions)×100). In some embodiments, the two sequences that are compared are the same length after gaps are introduced within the sequences, as appropriate (e.g., excluding additional sequence extending beyond the sequences being compared). For example, when variable region sequences are compared, the leader and/or constant domain sequences are not considered. For sequence comparisons between two sequences, a "corresponding" CDR refers to a CDR in the same location in both sequences (e.g., CDR-H1 of each sequence).

The determination of percent identity or percent similarity between two sequences can be accomplished using a mathematical algorithm. A preferred, non-limiting example of a mathematical algorithm utilized for the comparison of two sequences is the algorithm of Karlin and Altschul, 1990, Proc. Natl. Acad. Sci. USA 87:2264-2268, modified as in Karlin and Altschul, 1993, Proc. Natl. Acad. Sci. USA 90:5873-5877. Such an algorithm is incorporated into the NBLAST and XBLAST programs of Altschul et al., 1990, J. Mol. Biol. 215:403-410. BLAST nucleotide searches can be performed with the NBLAST program, score=100, wordlength=12, to obtain nucleotide sequences homologous to a nucleic acid encoding a protein of interest. BLAST protein searches can be performed with the XBLAST program, score=50, wordlength=3, to obtain amino acid sequences homologous to a protein of interest. To obtain gapped alignments for comparison purposes, Gapped BLAST can be utilized as described in Altschul et al., 1997, Nucleic Acids Res. 25:3389-3402. Alternatively, PSI-Blast can be used to perform an iterated search which detects distant relationships between molecules (Id.). When utilizing BLAST, Gapped BLAST, and PSI-Blast programs, the default parameters of the respective programs (e.g., XBLAST and NBLAST) can be used. Another preferred, non-limiting example of a mathematical algorithm utilized for the comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used. Additional algorithms for sequence analysis are known in the art and include ADVANCE and ADAM as described in Torellis and Robotti, 1994, Comput. Appl. Biosci. 10:3-5; and FASTA described in Pearson and Lipman, 1988, Proc. Natl. Acad. Sci. USA 85:2444-8. Within FASTA, ktup is a control option that sets the sensitivity and speed of the search. If ktup=2, similar regions in the two sequences being compared are found by looking at pairs of aligned residues; if ktup=1, single aligned amino acids are examined ktup can be set to 2 or 1 for protein sequences, or from 1 to 6 for DNA sequences. The default if ktup is not specified is 2 for proteins and 6 for DNA. Alternatively, protein sequence alignment may be carried out using the CLUSTAL W algorithm, as described by Higgins et al., 1996, Methods Enzymol. 266:383-402.

A further aspect of the invention provides a method of production of a binding molecule of any one of the previous claims, comprising:

(a) cultivating the host cell of the invention under conditions allowing expression of the molecule; and,
(b) recovering the molecule.

An embodiment of this aspect of the invention is wherein the method of production further comprises step (c) further purifying and/or modifying and/or formulating the binding molecule of the invention.

For producing the binding molecules of the invention, the DNA molecules encoding full-length light and/or heavy chains or fragments thereof are inserted into an expression vector such that the sequences are operatively linked to transcriptional and translational control sequences.

For manufacturing the antibodies of the invention, the skilled artisan may choose from a great variety of expression systems well known in the art, e.g. those reviewed by Kipriyanov and Le Gall, 2004.

Expression vectors include plasmids, retroviruses, cosmids, EBV-derived episomes, and the like. The expression vector and expression control sequences are selected to be compatible with the host cell. The antibody light chain gene and the antibody heavy chain gene can be inserted into separate vectors. In certain embodiments, both DNA sequences are inserted into the same expression vector. Convenient vectors are those that encode a functionally complete human CH or CL immunoglobulin sequence, with appropriate restriction sites engineered so that any VH or VL sequence can be easily inserted and expressed, as described above. The constant chain is usually kappa or lambda for the antibody light chain, for the antibody heavy chain, it can be, without limitation, any IgG isotype (IgG1, IgG2, IgG3, IgG4) or other immunoglobulins, including allelic variants.

The recombinant expression vector may also encode a signal peptide that facilitates secretion of the antibody chain from a host cell. The DNA encoding the antibody chain may be cloned into the vector such that the signal peptide is linked in-frame to the amino terminus of the mature antibody chain DNA. The signal peptide may be an immunoglobulin signal peptide or a heterologous peptide from a non-immunoglobulin protein. Alternatively, the DNA sequence encoding the antibody chain may already contain a signal peptide sequence.

In addition to the DNA sequences encoding the antibody chains, the recombinant expression vectors carry regulatory sequences including promoters, enhancers, termination and polyadenylation signals and other expression control elements that control the expression of the antibody chains in a host cell. Examples for promoter sequences (exemplified for expression in mammalian cells) are promoters and/or enhancers derived from (CMV) (such as the CMV Simian Virus 40 (SV40) (such as the SV40 promoter/enhancer), adenovirus, (e.g., the adenovirus major late promoter (AdMLP)), polyoma and strong mammalian promoters such as native immunoglobulin and actin promoters. Examples for polyadenylation signals are BGH polyA, SV40 late or early polyA; alternatively, 3'UTRs of immunoglobulin genes etc. can be used.

The recombinant expression vectors may also carry sequences that regulate replication of the vector in host cells (e. g. origins of replication) and selectable marker genes. Nucleic acid molecules encoding the heavy chain or an antigen-binding portion thereof and/or the light chain or an antigen-binding portion thereof of a molecule of the invention, and vectors comprising these DNA molecules can be introduced into host cells, e.g. bacterial cells or higher eukaryotic cells, e.g. mammalian cells, according to transfection methods well known in the art, including liposome-mediated transfection, polycation-mediated transfection, protoplast fusion, microinjections, calcium phosphate precipitation, electroporation or transfer by viral vectors.

Preferably, the nucleic acid molecules encoding the heavy chain and the light chain are present on two vectors which are co-transfected into the host cell, preferably a mammalian cell.

Hence a further aspect of the invention provides a host cell comprising an expression vector comprising a nucleic acid molecule encoding the heavy chain and an expression vector comprising a nucleic acid molecule encoding the light chain.

Mammalian cell lines available as hosts for expression are well known in the art and include, inter alia, Chinese hamster ovary (CHO, CHO-DG44) cells, NSO, SP2/0 cells, HeLa cells, baby hamster kidney (BHK) cells, monkey kidney cells (COS), human carcinoma cells (e. g., Hep G2), A549 cells, 3T3 cells or the derivatives/progenies of any such cell line. Other mammalian cells, including but not limited to human, mice, rat, monkey and rodent cells lines, or other eukaryotic cells, including but not limited to yeast, insect and plant cells, or prokaryotic cells such as bacteria may be used. The binding molecule of the invention are produced by culturing the host cells for a period of time sufficient to allow for expression of the binding molecule in the host cells.

Antibody molecules are preferably recovered from the culture medium as a secreted polypeptide or it can be recovered from host cell lysates if for example expressed without a secretory signal. It is necessary to purify the antibody molecules using standard protein purification methods used for recombinant proteins and host cell proteins in a way that substantially homogenous preparations of the antibody are obtained. By way of example, state-of-the art purification methods useful for obtaining the binding molecules of the invention include, as a first step, removal of cells and/or particulate cell debris from the culture medium or lysate. The antibody is then purified from contaminant soluble proteins, polypeptides and nucleic acids, for example, by fractionation on immunoaffinity or ion-exchange columns, ethanol precipitation, reverse phase HPLC, Sephadex chromatography, chromatography on silica or on a cation exchange resin. As a final step in the process for obtaining a CD137 and FAP binding molecule, the purified antibody molecule may be dried, e.g. lyophilized, as described below for therapeutic applications.

A further aspect of the invention provides the binding molecule of the invention for use in medicine.

In one aspect, the invention pertains to a CD137/FAP binding molecule, wherein the binding molecule exhibits at least one of the following properties:
(a) binds to human CD137 with a $K_D$ of $1\times10^{-8}$ M or less;
(b) binds to human CD137 and cynomolgus monkey CD137;
(c) binds to human and cyno CD137 at the CRD3 epitope or CRD2/3 epitope
(d) blocks binding and/or competes for binding to human and cyno CD137 at the CRD3 epitope or CRD2/3 epitope with any of the herein described antigen binding molecules;
(d) does not substantially mediate CD137 clustering and T cell activation in the absence of FAP binding;
(e) increases T-cell proliferation (in an Mixed Lymphocyte Reaction (MLR) assay);
(f) increases interferon-gamma production in an MLR assay;
(g) increases IL-2 secretion in an MLR assay;
(h) does not inhibit the binding of CD137 to CD137L;
(i) stimulates antigen-specific memory responses;
(j) stimulates antibody responses;
(k) inhibits tumor cell growth in vivo; and
(l) does not exhibit liver toxicity in vivo.

Preferably the binding molecule less binds to human and cyno CD137 with a $K_D$ of between $1\times10^{-8}$ M and $1\times10^{-10}$ M and to human, cyno and mouse FAP proteins with a $K_D$ $1\times10^{-8}$ M and $1\times10^{-10}$ M.

In yet another aspect, the invention provides a CD137/FAP binding molecule, wherein the CD137 binding portion comprises a heavy chain variable region and a light chain variable region, wherein:
(a) the heavy chain variable region comprises an amino acid sequence that is at least 90%, at least 91%, at least 92%, at least 93%, at least 94%, at least 95%, at least 96%, at least 97%, at least 98%, at least 99% homologous to an amino acid sequence selected from the group consisting of SEQ ID NOs: 10, 20, 30, 40, 50, 60, 70, 80, 90, and 100;
(b) the light chain variable region comprises an amino acid sequence that is at least 90%, at least 91%, at least 92%, at least 93%, at least 94%, at least 95%, at least 96%, at least 97%, at least 98%, at least 99% homologous to an amino acid sequence selected from the group consisting of SEQ ID NOs: 15, 25, 35, 45, 55, 65, 75, 85, 95 and 105;
(c) the antibody binds to human CD137 with a $K_D$ of $1\times10^{-8}$M or less; and
(d) the antibody does not substantially mediate CD137 activation in the absence of FAP.

Preferred embodiments of the invention bind to human CD137 with a $K_D$ of $10^{-10}$ M and to cyno CD137 with a $K_D$ of $10^{-10}$ M. Preferred embodiments of the invention bind to human FAP with a $K_D$ of $10^{-10}$ M, cyno FAP with a $K_D$ of $10^{-10}$ M, and murine FAP with a $K_D$ of $10^{-9}$ M.

In yet another aspect, the invention provides a CD137 binding molecule, wherein the CD137 heavy chain variable region comprises an amino acid sequence derived from a human IGHV3-7*01 germline sequence; preferably wherein the CD137 binding molecule comprises a heavy chain variable region comprising an amino acid sequence which is at least 78%, 80%, 85%, 90%, 95%, 96%, 97%, 98%, 99% or 100% identical to an amino acid sequence selected from the group consisting of SEQ ID NOs: 10, 20, 30, 40, 50, and 60.

In yet another aspect, the invention provides a CD137 binding molecule, wherein the CD137 light chain variable region comprises an amino acid sequence derived from a human IGKV1-NL1*01 germline sequence; preferably wherein the light chain variable region comprises an amino acid sequence which is at least 75%, 80%, 85%, 90%, 95%, 96%, 97%, 98%, 99% or 100% identical to an amino acid sequence selected from the group consisting of SEQ ID NOs: 15, 25, 35, 45, 55, and 65.

In yet another aspect, the invention provides a FAP binding molecule, wherein the FAP heavy chain variable region comprises an amino acid sequence derived from a human IGHV3-23*04 germline sequence; preferably wherein the FAP binding molecule comprises a heavy chain variable region comprising an amino acid sequence which is at least 78%, 80%, 85%, 90%, 95%, 96%, 97%, 98%, 99% or 100% identical to an amino acid sequence selected from the group consisting of SEQ ID Nos.:106, 115, 124, 133, or 142.

In yet another aspect, the invention provides a FAP binding molecule, wherein the FAP light chain variable region comprises an amino acid sequence derived from a human IGKV3-11*01 germline sequence; preferably wherein the FAP binding molecule comprises a light chain variable region comprising an amino acid sequence which is at least 78%, 80%, 85%, 90%, 95%, 96%, 97%, 98%, 99% or 100% identical to an amino acid sequence selected from the group consisting of SEQ ID Nos.:110, 119, 128, 137, or 146.

In yet another aspect, the invention provides a CD137/FAP binding molecule, wherein the FAP binding portion comprises a heavy chain variable region and a light chain variable region, wherein:
  (a) the heavy chain variable region comprises an amino acid sequence that is at least 90%, at least 91%, at least 92%, at least 93%, at least 94%, at least 95%, at least 96%, at least 97%, at least 98%, at least 99% homologous to an amino acid sequence selected from the group consisting of SEQ ID NOs: 106, 115, 124, 133, and 142;
  (b) the light chain variable region comprises an amino acid sequence that is at least 90%, at least 91%, at least 92%, at least 93%, at least 94%, at least 95%, at least 96%, at least 97%, at least 98%, at least 99% homologous to an amino acid sequence selected from the group consisting of SEQ ID NOs: 110, 119, 128, 137, and 146;
  (c) the antibody of (a) and (b) binds to human CD137 with a $K_D$ of $1\times10^{-7}$M or less; and
  (d) the antibody of (a)-(c) does not substantially bind to human CD137L or CD137 in the absence of FAP cross-linking.

In yet another aspect, the invention provides a CD137/FAP binding molecule, wherein the FAP binding portion comprises a heavy chain variable region and a light chain variable region, wherein:
  (a) the heavy chain variable region comprises an amino acid sequence that is at least 90%, at least 91%, at least 92%, at least 93%, at least 94%; at least 95%, at least 96%, at least 97%, at least 98%, at least 99% homologous to an amino acid sequence selected from the group consisting of SEQ ID NOs: 106, 115, 124, 133, and 142;
  (b) the light chain variable region comprises an amino acid sequence that is at least 90%, at least 91%, at least 92%, at least 93%, at least 94%, at least 95%, at least 96%, at least 97%, at least 98%, at least 99% homologous to an amino acid sequence selected from the group consisting of SEQ ID NOs: 110, 119, 128, 137, and 146;
  (c) the antibody of (a) and (b) binds to an epitope on human CD137 in the extracellular domain CRD3 between amino acids 87-118 (SEQ ID NO.:352); or
  (d) the antibody of (a) and (b) binds to an epitope on human CD137 in the extracellular domain CRD 2-3 between amino acids 46-117 (SEQ ID NO.:356); and
  (e) the antibody of (a)-(c) does not substantially mediate CD137 clustering and T cell activation in the absence of FAP binding.

In a preferred embodiment, the CD137/FAP binding molecules as described above additionally comprise at least one of the following properties:
  (a) the antibody increases T-cell proliferation (in an MLR assay);
  (b) the antibody increases interferon-gamma production (in an MLR assay); or
  (c) the antibody increases IL-2 secretion (in an MLR assay).

Additionally, or alternatively, the CD137/FAP binding molecules may comprise one or more of the other features listed above.

A further aspect of the invention provides the binding molecule of the invention for use in the treatment or therapy of cancer. As used herein, "treatment" or "therapy" (and variations thereof such as "treat" or "treating", "therapeutic") refers to clinical intervention in an attempt to alter the natural course of the individual being treated, and can be performed during the course of clinical pathology. Desirable effects of treatment include, but are not limited to, limiting occurrence or recurrence of disease, alleviation of symptoms, and diminishment of any direct or indirect pathological consequences of the disease, preventing metastasis, decreasing the rate of disease progression, amelioration or palliation of the disease state, and remission or improved prognosis. In some embodiments, the molecules of the invention are used to delay development of a disease or to slow the progression of a disease. In one aspect the invention is used for the treatment of T-cell infiltrated/FAP positive tumors. It is preferred that the cancer is colorectal cancer (CRC) (e.g., colorectal adenocarcinoma), gastric cancer (GC) (e.g., gastric adenocarcinoma), pancreatic cancer (PAC) (e.g., pancreatic adenocarcinoma), lung cancer (LC) (e.g., lung squamous cell carcinoma, lung adenocarcinoma, non-small cell lung cancer (NSCLC)), head and neck cancer, urothelial cancer, or melanoma, although other solid malignancies, which make up 90% of all cancers, are contemplated because of the unmet clinical need for novel treatments for these types of hard to permeate tumors.

As stated above the inventors have identified that the binding molecule of the invention has much utility for FAP+Tissue-restricted CD137 activation of T cells and tumor killing and therefore can be used in the therapy of cancers which have co-localized expression of both CD137 (4-1BB, TNFRSF9) and Fibroblast Activation Protein (FAP). Methods of identifying whether a particular tumor has co-localized expression of CD137 (4-1BB, TNFRSF9) and Fibroblast Activation Protein (FAP) are well known in the art. For example, immunohistochemistry can be used to determine whether tumor tissue expresses CD137 (4-1BB, TNFRSF9) and Fibroblast Activation Protein (FAP) and hence would be suitable for treatment with the binding molecule of the invention.

CRC is a distinct malignant disease listed in ICD-10 and one of the leading causes of cancer morbidity and mortality worldwide. Approximately 25% of CRC patients present with overt metastasis and metastatic disease develops in 40-50% of newly diagnosed patients. Although recent improvements in chemotherapy have extended survival durations of metastatic CRC, most patients will succumb to their disease. Hence, there is a great need for further therapeutic agents to treat this disease.

In a further aspect the present invention relates to methods for the treatment or prevention of cancer, which method comprises the administration of an effective amount of any of the of CD137/FAP binding molecules as described above to a human being.

The preferred mode of application is parenteral, by infusion or injection (intravenous, intramuscular, subcutaneous, intraperitoneal, intradermal), but other modes of application such as by inhalation, transdermal, intranasal, buccal, oral, may also be applicable.

The "therapeutically effective amount" of the molecule to be administered is the minimum amount necessary to prevent, ameliorate, or treat clinical symptoms of cancer, in particular the minimum amount which is effective to these disorders.

The dose range of the antibodies of the invention applicable per day is usually from 1 µg/kg to 100 mg/kg, preferably from 0.1 mg/kg to 20 mg/kg.

The actual pharmaceutically effective amount or therapeutic dosage will of course depend on factors known by those skilled in the art such as age and weight of the patient, route of administration and severity of disease. In any case, the combination will be administered at dosages and in a manner that allows a pharmaceutically effective amount to be delivered based upon patient's unique condition The binding molecules of the invention may be used on their own or in combination with other pharmacologically active ingredients, such as state-of-the-art or standard-of-care compounds, such as e.g. cytostatic or cytotoxic substances, cell proliferation inhibitors, angiogenic substances, steroids, immune modulators/checkpoint inhibitors, and the like.

Hence a further aspect of the invention provides a pharmaceutical composition comprising a binding molecule according to any one of the embodiments of the invention, together with a pharmaceutically acceptable carrier and optionally one or more further active ingredients.

A further aspect of the invention provides a binding molecule of the invention for use in the therapy of cancer wherein said therapy comprises one or more pharmacologically active substances.

In a further embodiment the present invention provides an antibody or antigen-binding fragment or pharmaceutical composition according to any one of the anti-CD137/FAP embodiments described above, or the use of the anti-CD137/FAP antibody or antigen-binding fragment according for the use in the treatment of disease, wherein the use is for the treatment of cancer and/or tumors A further aspect of the invention provides the use of one or more active ingredients in the manufacture of a medicament for the therapy of cancer and/or tumors wherein said medicament comprises a binding molecule of any one of the embodiments of the invention.

Cytostatic and/or cytotoxic active substances which may be administered in combination with binding molecules of the invention include, without being restricted thereto, hormones, hormone analogues and antihormones, aromatase inhibitors, LHRH agonists and antagonists, inhibitors of growth factors (growth factors such as for example platelet derived growth factor (PDGF), fibroblast growth factor (FGF), vascular endothelial growth factor (VEGF), epidermal growth factor (EGF), insulin-like growth factors (IGF), human epidermal growth factor (HER, e.g. HER2, HER3, HER4) and hepatocyte growth factor (HGF)), inhibitors are for example ( )growth factor antibodies, ( )growth factor receptor antibodies and tyrosine kinase inhibitors, such as for example cetuximab, gefitinib, afatinib, nintedanib, imatinib, lapatinib, bosutinib and trastuzumab; antimetabolites (e.g. antifolates such as methotrexate, raltitrexed, pyrimidine analogues such as 5-fluorouracil (5-FU), gemcitabine, irinotecan, doxorubicin, TAS-102, capecitabine and gemcitabine, purine and adenosine analogues such as mercaptopurine, thioguanine, cladribine and pentostatin, cytarabine (ara C), fludarabine); antitumor antibiotics (e.g. anthracyclins); platinum derivatives (e.g. cisplatin, oxaliplatin, carboplatin); alkylation agents (e.g. estramustin, meclorethamine, melphalan, chlorambucil, busulphan, dacarbazin, cyclophosphamide, ifosfamide, temozolomide, nitrosoureas such as for example carmustin and lomustin, thiotepa); antimitotic agents (e.g. *Vinca* alkaloids such as for example vinblastine, vindesin, vinorelbin and vincristine; and taxanes such as paclitaxel, docetaxel); angiogenesis inhibitors, including bevacizumab, ramucirumab and aflibercept, tubuline inhibitors; DNA synthesis inhibitors, PARP inhibitors, topoisomerase inhibitors (e.g. epipodophyllotoxins such as for example etoposide and etopophos, teniposide, amsacrin, topotecan, irinotecan, mitoxantrone), serine/threonine kinase inhibitors (e.g. PDK1 inhibitors, Raf inhibitors, A-Raf inhibitors, B-Raf inhibitors, C-Raf inhibitors, mTOR inhibitors, mTORC1/2 inhibitors, PI3K inhibitors, PI3Kα inhibitors, dual mTOR/PI3K inhibitors, STK33 inhibitors, AKT inhibitors, PLK1 inhibitors (such as volasertib), inhibitors of CDKs, including CDK9 inhibitors, Aurora kinase inhibitors), tyrosine kinase inhibitors (e.g. PTK2/FAK inhibitors), protein protein interaction inhibitors, MEK inhibitors, ERK inhibitors, FLT3 inhibitors, BRD4 inhibitors, IGF-1R inhibitors, Bcl-xL inhibitors, Bcl-2 inhibitors, Bcl-2/Bcl-xL inhibitors, ErbB receptor inhibitors, BCR-ABL inhibitors, ABL inhibitors, Src inhibitors, rapamycin analogs (e.g. everolimus, temsirolimus, ridaforolimus, sirolimus), androgen synthesis inhibitors, androgen receptor inhibitors, DNMT inhibitors, HDAC inhibitors, ANG1/2 inhibitors, CYP17 inhibitors, radiopharmaceuticals, immunotherapeutic agents such as immune checkpoint inhibitors (e.g. CTLA4, PD1, PD-L1, LAG3, and TIM3 binding molecules/immunoglobulins, such as ipilimumab, nivolumab, pembrolizumab) and various chemotherapeutic agents such as amifostin, anagrelid, clodronat, filgrastin, interferon, interferon alpha, leucovorin, rituximab, procarbazine, levamisole, mesna, mitotane, pamidronate and porfimer; proteasome inhibitors (such as Bortezomib); Smac and BH3 mimetics; agents restoring p53 functionality including mdm2-p53 antagonist; inhibitors of the Wnt/beta-catenin signaling pathway; and/or cyclin-dependent kinase 9 inhibitors.

Increasingly evidence has suggested that PD-1 signaling is an important mechanism utilized by tumors to escape antitumor immune responses (Dong, et al, 2002, Iwai et al, 2002; Shin and Ribas, 2015). Recent clinical trials with anti-PD-1 and PD-L1 monoclonal antibodies have shown clinical responsiveness in some patients with a variety of cancers. These immune checkpoint inhibitors block the interaction between PD-1 and PD-L1 to restore the stimulation signal and promote T cell activation, ones with more tumor infiltrating T cells (TILs), which can provoke strong immune responses to eliminate cancer cells. In such a situation, the CD137/FAP molecules of the invention can augment the elimination of cancer cells by activating and/or recruiting and/or maintaining TILs in the tumor microenvironment. Unfortunately, only a minority of total treated patients respond to current immunotherapy treatment. For example, colorectal carcinoma (CRC) cells express less PD-L1 and it has been reported by Valentini et al. (Oncotarget, 2018) that the expression of PD-L1 in MSS CRC (microsatellite stable (MSS) tumors) is mainly restricted to tumor-infiltrating immune cells. This could explain why MSS CRC patients failed to respond to anti-PD-1/PD-L1 therapy. Thus it has become a top priority to develop modalities which can potentially increase the patient response rate.

Studies have suggested that the presence of tumor infiltrating lymphocytes (TILs) (i.e. "hot tumors") or absence of tumor infiltrating lymphocytes (TILs) (i.e., "cold tumors") are important for predicting responses to PD-1 therapy, correlating the presence of TILS with better patient outcomes during various antitumor therapies (Galon et al., 2006; Hwang et al., 2012; Mahmoud et al. 2011). Thus one aspect of this invention is the combination of CD137/FAP bispecific molecules with modalities which turn "cold"

tumors "hot". For example, embodiments of the invention combine immunotherapies that can dampen PDL-1 inhibition (and/or otherwise overcome checkpoint blockade resistance) with CD137/FAP bispecific molecules which specifically target FAP+ expressing tumors. The combination of these modalities releases inhibition on the one hand, while increasing new T cell infiltration to the tumor site and/or promoting retention and activation of T cells in the tumor microenvironment on the other; a two-prong approach. The combination of modalities results in better tumor control than either treatment alone.

With the above in mind, particularly preferred are treatments with the CD137/FAP binding molecules of the invention in combination with a drug selected from below:
(i) immunotherapeutic agents, including PD-1 and PD-L1 agents, such as pembrolizumab and nivolumab, e.g. for treatment of CRC patients (discussed below)
(ii) SIRPα antibodies (e.g., any SIRP antagonist, especially antibodies, preferably such as those disclosed in WO2017/178653, herein incorporated by reference and other examples as disclosed in WO20200068752 and WO2019023347);
(iii) TcEngagers (e.g, preferably as disclosed in WO2019234220 and EP19201200.3)
(iv) KISIMA vaccine (e.g., preferably as disclosed in WO2016/146260 and WO2018/055060 and incorporated by reference herein);
(v) Oncolytic Virus (e.g., preferably Vesicular Stomatitis Virus with or without specific gene cargo, such as VSV-GP and VSV-CCL21 as disclosed in WO2010/040526 and PCT/EP2020/051701 respectively, and incorporated by reference herein);
(vi) STING agonists (e.g., preferably as disclosed in WO2018060323 and U.S. Pat. No. 10,537,590 and incorporated by reference herein); and
(vii) chemotherapeutics used for the treatment of CRC (including 5-fluorouracil, irinotecan, doxorubicin and TAS-102).

A PD-1 pathway inhibitor within the meaning of this invention and all of its embodiments is a compound that inhibits the interaction of PD-1 with its receptor(s). A PD-1 pathway inhibitor is capable to impair the PD-1 pathway signaling, preferably mediated by the PD-1 receptor. The PD-1 inhibitor may be any inhibitor directed against any member of the PD-1 pathway capable of antagonizing PD-1 pathway signaling. The inhibitor may be an antagonistic antibody targeting any member of the PD-1 pathway, preferably directed against PD-1 receptor, PD-L1 or PD-L2. Also, the PD-1 pathway inhibitor may be a fragment of the PD-1 receptor or the PD-1 receptor blocking the activity of PD1 ligands.

PD-1 antagonists are well-known in the art, e.g. reviewed by Li et al., Int. J. Mol. Sci. 2016, 17, 1151 (incorporated herein by reference). Any PD-1 antagonist, especially antibodies, such as those disclosed by Li et al. as well as the further antibodies disclosed herein below, can be used according to the invention. Preferably, the PD-1 antagonist of this invention and all its embodiments is selected from the group consisting of the following antibodies: pembrolizumab (anti-PD-1 antibody); nivolumab (anti-PD-1 antibody); pidilizumab (anti-PD-1 antibody); PDR-001 (anti-PD-1 antibody); PD1-1, PD1-2, PD1-3, PD1-4, and PD1-5, preferably BI-754019 as disclosed herein below (anti-PD-1 antibodies), atezolizumab (anti-PD-L1 antibody); avelumab (anti-PD-L1 antibody); durvalumab (anti-PD-L1 antibody).

Pembrolizumab (formerly also known as lambrolizumab; trade name Keytruda; also known as MK-3475) disclosed e.g. in Hamid, O. et al. (2013) New England Journal of Medicine 369(2):134-44, is a humanized IgG4 monoclonal antibody that binds to PD-1; it contains a mutation at C228P designed to prevent Fc-mediated cytotoxicity. Pembrolizumab is e.g. disclosed in U.S. Pat. No. 8,354,509 and WO2009/114335. It is approved by the FDA for the treatment of patients suffering from unresectable or metastatic melanoma and patients with metastatic NSCLC.

Nivolumab (CAS Registry Number: 946414-94-4; BMS-936558 or MDX1106b) is a fully human IgG4 monoclonal antibody which specifically blocks PD-1, lacking detectable antibody-dependent cellular toxicity (ADCC). Nivolumab is e.g. disclosed in U.S. Pat. No. 8,008,449 and WO2006/121168. It has been approved by the FDA for the treatment of patients suffering from unresectable or metastatic melanoma, metastatic NSCLC and advanced renal cell carcinoma.

Pidilizumab (CT-011; Cure Tech) is a humanized IgG1k monoclonal antibody that binds to PD-1. Pidilizumab is e.g. disclosed in WO2009/101611.

PDR-001 or PDR001 is a high-affinity, ligand-blocking, humanized anti-PD-1 IgG4 antibody that blocks the binding of PD-L1 and PD-L2 to PD-1. PDR-001 is disclosed in WO2015/112900 and WO2017/019896.

Antibodies PD1-1 to PD1-5 are antibody molecules defined by the sequences as shown in Table 4, wherein HC denotes the (full length) heavy chain and LC denotes the (full length) light chain:

TABLE 4

| SEQ ID NO.: | Sequence name | Amino acid sequence |
|---|---|---|
| 652 | HC of PD1-1 | EVMLVESGGGLVQPGGSLRLSCTASGFTFSASAMSWVRQAPGKGLEWVAYISGGGGDTY YSSSVKGRFTISRDNAKNSLYLQMNSLRAEDTAVYYCARHSNVNYYAMDYWGQGTLVTV SSASTKGPSVFPLAPCSRSTSESTAALGCLVKDYFPEPVTVSWNSGALTSGVHTFPAVL QSSGLYSLSSVVTVPSSSLGTKTYTCNVDHKPSNTKVDKRVESKYGPPCPPCPAPEFLG GPSVFLFPPKPKDTLMISRTPEVTCVVVDVSQEDPEVQFNWYVDGVEVHNAKTKPREEQ FNSTYRVVSVLTVLHQDWLNGKEYKCKVSNKGLPSSIEKTISKAKGQPREPQVYTLPPS QEEMTKNQVSLTCLVKGFYPSDIAVEWESNGQPENNYKTIPPVLDSDGSFFLYSRLTVD KSRWQEGNVFSCSVMHEALHNHYTQKSLSLSLG |
| 653 | LC of PD1-1 | EIVLTQSPATLSLSPGERATMSCRASENIDTSGISFMNWYQQKPGQAPKWYVASNQGSG IPARFSGSGSGTDFTLTISRLEPEDFAVYYCQQSKEVPWTFGQGTKLEIKRTVAAPSVF IFPPSDEQLKSGTASVVCLLNNFYPREAKVQWKVDNALQSGNSQESVTEQDSKDSTYSL SSTLTLSKADYEKHKVYACEVTHQGLSSPVTKSFNRGEC |

TABLE 4-continued

| SEQ ID NO.: | Sequence name | Amino acid sequence |
|---|---|---|
| 654 | HC of PD1-2 | EVMLVESGGGLVQPGGSLRLSCTASGFTFSASAMSWVRQAPGKGLEWVAYISGGGGDTY YSSSVKGRFTISRDNAKNSLYLQMNSLRAEDTAVYYCARHSNPNYYAMDYWGQGTLVTV SSASTKGPSVFPLAPCSRSTSESTAALGCLVKDYFPEPVTVSWNSGALTSGVHTFPAVL QSSGLYSLSSVVTVPSSSLGTKTYTCNVDHKPSNTKVDKRVESKYGPPCPPCPAPEFLG GPSVFLFPPKPKDTLMISRTPEVTCVVVDVSQEDPEVQFNWYVDGVEVHNAKTKPREEQ FNSTYRVVSVLTVLHQDWLNGKEYKCKVSNKGLPSSIEKTISKAKGQPREPQVYTLPPS QEEMTKNQVSLTCLVKGFYPSDIAVEWESNGQPENNYKTTPPVLDSGSFFLYSRLTVD KSRWQEGNVFSCSVMHEALHNHYTQKSLSLSLG |
| 655 | LC of PD1-2 | EIVLTQSPATLSLSPGERATMSCRASENIDTSGISFMNWYQQKPGQAPKLLIYVASNQG SGIPARFSGSGSGTDFTLTISRLEPEDFAVYYCQQSKEVPWTFGQGTKLEIKRTVAAPS VFIFPPSDEQLKSGTASVVCLLNNFYPREAKVQWKVDNALQSGNSQESVTEQDSKDSTY SLSSTLTLSKADYEKHKVYACEVTHQGLSSPVTKSFNRGEC |
| 656 | HC of PD1-3 | EVMLVESGGGLVQPGGSLRLSCTASGFTFSKSAMSWVRQAPGKGLEWVAYISGGGGDTY YSSSVKGRFTISRDNAKNSLYLQMNSLRAEDTAVYYCARHSNVNYYAMDYWGQGTLVTV SSASTKGPSVFPLAPCSRSTSESTAALGCLVKDYFPEPVTVSWNSGALTSGVHTFPAVL QSSGLYSLSSVVTVPSSSLGTKTYTCNVDHKPSNTKVDKRVESKYGPPCPPCPAPEFLG GPSVFLFPPKPKDTLMISRTPEVTCVVVDVSQEDPEVQFNWYVDGVEVHNAKTKPREEQ FNSTYRVVSVLTVLHQDWLNGKEYKCKVSNKGLPSSIEKTISKAKGQPREPQVYTLPPS QEEMTKNQVSLTCLVKGFYPSDIAVEWESNGQPENNYKTIPPVLDSGSFFLYSRLTVD KSRWQEGNVFSCSVMHEALHNHYTQKSLSLSLG |
| 657 | LC of PD1-3 | EIVLTQSPATLSLSPGERATMSCRASENIDVSGISFMNWYQQKPGQAPKWYVASNQGSG IPARFSGSGSGTDFTLTISRLEPEDFAVYYCQQSKEVPWTFGQGTKLEIKRTVAAPSVF IFPPSDEQLKSGTASVVCLLNNFYPREAKVQWKVDNALQSGNSQESVTEQDSKDSTYSL SSTLTLSKADYEKHKVYACEVTHQGLSSPVTKSFNRGEC |
| 658 | HC of PD1-4 | EVMLVESGGGLVQPGGSLRLSCTASGFTFSKSAMSWVRQAPGKGLEWVAYISGGGGDTY YSSSVKGRFTISRDNAKNSLYLQMNSLRAEDTAVYYCARHSNVNYYAMDYWGQGTLVTV SSASTKGPSVFPLAPCSRSTSESTAALGCLVKDYFPEPVTVSWNSGALTSGVHTFPAVL QSSGLYSLSSVVTVPSSSLGTKTYTCNVDHKPSNTKVDKRVESKYGPPCPPCPAPEFLG GPSVFLFPPKPKDTLMISRTPEVTCVVVDVSQEDPEVQFNWYVDGVEVHNAKTKPREEQ FNSTYRVVSVLTVLHQDWLNGKEYKCKVSNKGLPSSIEKTISKAKGQPREPQVYTLPPS QEEMTKNQVSLTCLVKGFYPSDIAVEWESNGQPENNYKTTPPVLDSGSFFLYSRLTVD KSRWQEGNVFSCSVMHEALHNHYTQKSLSLSLG |
| 659 | LC of PD1-4 | EIVLTQSPATLSLSPGERATMSCRASENIDVSGISFMNWYQQKPGQAPKWYVASNQGSG IPARFSGSGSGTDFTLTISRLEPEDFAVYYCQQSKEVPWTFGQGTKLEIKRTVAAPSVF IFPPSDEQLKSGTASVVCLLNNFYPREAKVQWKVDNALQSGNSQESVTEQDSKDSTYSL SSTLTLSKADYEKHKVYACEVTHQGLSSPVTKSFNRGEC |
| 660 | HC of PD1-5 | EVMLVESGGGLVQPGGSLRLSCTASGFTFSKSAMSWVRQAPGKGLEWVAYISGGGGDTY YSSSVKGRFTISRDNAKNSLYLQMNSLRAEDTAVYYCARHSNVNYYAMDYWGQGTLVTV SSASTKGPSVFPLAPCSRSTSESTAALGCLVKDYFPEPVTVSWNSGALTSGVHTFPAVL QSSGLYSLSSVVTVPSSSLGTKTYTCNVDHKPSNTKVDKRVESKYGPPCPPCPAPEFLG GPSVFLFPPKPKDTLMISRTPEVTCVVVDVSQEDPEVQFNWYVDGVEVHNAKTKPREEQ FNSTYRVVSVLTVLHQDWLNGKEYKCKVSNKGLPSSIEKTISKAKGQPREPQVYTLPPS QEEMTKNQVSLTCLVKGFYPSDIAVEWESNGQPENNYKTTPPVLDSGSFFLYSRLTVD KSRWQEGNVFSCSVMHEALHNHYTQKSLSLSLG |
| 661 | LC of PD1-5 | EIVLTQSPATLSLSPGERATMSCRASENIDVSGISFMNWYQQKPGQAPKWYVASNQGSG IPARFSGSGSGTDFTLTISRLEPEDFAVYYCQQSKEVPWTFGQGTKLEIKRTVAAPSVF IFPPSDEQLKSGTASVVCLLNNFYPREAKVQWKVDNALQSGNSQESVTEQDSKDSTYSL SSTLTLSKADYEKHKVYACEVTHQGLSSPVTKSFNRGEC |

Specifically, the anti-PD-1 antibody molecule described herein above has:

(PD1-1) a heavy chain comprising the amino acid sequence of SEQ ID NO.:652 and a light chain comprising the amino acid sequence of SEQ ID NO.:653; or (PD1-2) a heavy chain comprising the amino acid sequence of SEQ ID NO.:654 and a light chain comprising the amino acid sequence of SEQ ID NO.: 655; or (PD1-3) a heavy chain comprising the amino acid sequence of SEQ ID NO.:656 and a light chain comprising the amino acid sequence of SEQ ID NO.:657; or (PD1-4) a heavy chain comprising the amino acid sequence of SEQ ID NO.:658 and a light chain comprising the amino acid sequence of SEQ ID NO.:659; or (PD1-5) a heavy chain comprising the amino acid sequence of SEQ ID NO.:660 and a light chain comprising the amino acid sequence of SEQ ID NO.:661.

Atezolizumab (Tecentriq, also known as MPDL3280A) is a phage-derived human IgG1k monoclonal antibody targeting PD-L1 and is described e.g. in Deng et al. mAbs 2016; 8:593-603. It has been approved by the FDA for the treatment of patients suffering from urothelial carcinoma.

Avelumab is a fully human anti-PD-L1 IgG1 monoclonal antibody and described in e.g. Boyerinas et al. Cancer Immunol. Res. 2015; 3:1148-1157.

Durvalumab (MEDI4736) is a human IgG1k monoclonal antibody with high specificity to PD-L1 and described in e.g. Stewart et al. Cancer Immunol. Res. 2015; 3:1052-1062 or in Ibrahim et al. Semin. Oncol. 2015; 42:474-483.

Further PD-1 antagonists disclosed by Li et al. (supra), or known to be in clinical trials, such as AMP-224, MEDI0680 (AMP-514), REGN2810, BMS-936559, JS001-PD-1, SHR-1210, BMS-936559, TSR-042, JNJ-63723283, MEDI4736, MPDL3280A, and MSB0010718C, may be used as alternative or in addition to the above mentioned antagonists.

The INNs as used herein are meant to also encompass all biosimilar antibodies having the same, or substantially the same, amino acid sequences as the originator antibody, including but not limited to those biosimilar antibodies authorized under 42 USC § 262 subsection (k) in the US and equivalent regulations in other jurisdictions.

PD-1 antagonists listed above are known in the art with their respective manufacture, therapeutic use and properties.

In one embodiment the PD-1 antagonist is pembrolizumab.

In another embodiment the PD-1 antagonist is nivolumab.

In another embodiment the PD-1 antagonist is pidilizumab.

In another embodiment the PD-1 antagonist is atezolizumab.

In another embodiment the PD-1 antagonist is avelumab.

In another embodiment the PD-1 antagonist is durvalumab.

In another embodiment the PD-1 antagonist is PDR-001.

In preferred embodiments, the protein of the invention is used for the treatment of cancer in combination with a PD-1 antagonist, selected from the group consisting of PD1-1, PD1-2, PD1-3, PD1-4, and PD1-5 e.g., CD137 #1/FAP #1, CD137 #7/FAP #1, CD137 #1/FAP #4, CD137 #7/FAP #4, CD137 #2/FAP #5, CD137 #2/FAP #2, CD137 #2/FAP #3, CD137 #3/FAP #5, CD137 #3/FAP #2, CD137 #3/FAP #3, CD137 #4/FAP #5, CD137 #4/FAP #2, CD137 #4/FAP #3, CD137 #5/FAP #5, CD137 #5/FAP #2, CD137 #5/FAP #3, CD137 #6/FAP #5, CD137 #6/FAP #2, CD137 #6/FAP #3, CD137 #8/FAP #5, CD137 #8/FAP #2, CD137 #8/FAP #3, CD137 #9/FAP #5, CD137 #9/FAP #2, and CD137 #9/FAP #3, CD137 #10/FAP #5, CD137 #10/FAP #2, CD137 #10/FAP #3.

To be used in therapy, the binding molecule of the invention is formulated into pharmaceutical compositions appropriate to facilitate administration to animals or humans Typical formulations of the antibody molecule can be prepared by mixing the antibody molecule with physiologically acceptable carriers, excipients or stabilizers, in the form of lyophilized or otherwise dried formulations or aqueous solutions or aqueous or non-aqueous suspensions. Carriers, excipients, modifiers or stabilizers are nontoxic at the dosages and concentrations employed. They include buffer systems such as phosphate, citrate, acetate and other inorganic or organic acids and their salts; antioxidants including ascorbic acid and methionine; preservatives such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol; proteins, such as serum albumin, gelatin, or immunoglobulins; hydrophilic polymers such as polyvinylpyrrolidone or polyethylene glycol (PEG); amino acids such as glycine, glutamine, asparagine, histidine, arginine, or lysine; monosaccharides, disaccharides, oligosaccharides or polysaccharides and other carbohydrates including glucose, mannose, sucrose, trehalose, dextrins or dextrans; chelating agents such as EDTA; sugar alcohols such as, mannitol or sorbitol; salt-forming counter-ions such as sodium; metal complexes (e.g., Zn-protein complexes); and/or ionic or non-ionic surfactants such as TWEEN™ (polysorbates), PLURONICS™ or fatty acid esters, fatty acid ethers or sugar esters. Also organic solvents can be contained in the antibody formulation such as ethanol or isopropanol. The excipients may also have a release-modifying or absorption-modifying function.

The invention is now described by way of the following non-limiting examples

Example 1: Design of Binding Molecules Recognizing Human CD137 (4-1BB, TNFRSF9) and Fibroblast Activation Protein (FAP) in the Context of the Tumor Microenvironment The present inventors have developed binding molecules that bind CD137 (4-1BB, TNFRSF9) and Fibroblast Activation Protein (FAP) and that targets CD137 T cell activation and recruitment to FAP expressing fibroblast in the tumor stroma. The molecular design used has an IgG antibody (termed the "master antibody") which has specificity for one target antigen, with scFvs of different specificities coupled to the C terminus of the heavy chain. A schematic of the design is shown in FIG. 1A. A schematic of the mode of action is shown in FIG. 1B.

Preferably the binding molecule is bispecific and tetravalent.

The bispecific molecule contains flexible peptide sequences between the variable heavy (VH) and variable light (VL) domains of the scFv, and the scFv domains are linked to the master IgG antibody via further series of linkers. In one configuration, the scFv is oriented such that the VL domain forms the "N-terminal" end of the scFv and is thus fused to the C-terminus of the heavy chain of the master antibody while the VH forms the C-terminus of the scFv and indeed the whole heavy chain polypeptide. However, it can be appreciated that this "N-VL-VH-C" structure can be reversed, i.e. "N-VH-VL-C".

The following Examples explain the methods used to generate the bispecific molecule that binds CD137 (4-1BB, TNFRSF9) and Fibroblast Activation Protein (FAP) as well as variations in the format and the biological activity of these molecules.

Example 2: Preparation of Binding Domains that Recognize CD137 (4-1BB, TNFRSF9)

As can be appreciated, to prepare bispecific molecules binding to human CD137 (4-1BB, TNFRSF9) and Fibroblast Activation Protein (FAP), it is necessary to obtain variable domains bind to the individual target antigens.

a. Immunization Campaign for CD137

To prepare bispecific molecules binding to human CD137 (4-1BB, TNFRSF9), clonal hybridomas or single B cells derived from CD137 (4-1BB, TNFRSF9) immunized mice were cultured in vitro. Supernatants were screened for reactivity against human CD137 (4-1BB, TNFRSF9) Immunoglobulin (Ig) VH and VL genes were then amplified from identified positive clones.

Briefly, wild type CD1 mice, were immunized with human and cynomolgus CD137-Fc_His proteins (SEQ ID Nos.:349 and 359, respectively). Complete Freund's adjuvant was used at various points to augment antibody responses. Serology was assessed by ELISA with human and cynomolgus CD137-Fc-His protein as antigens. Serologically positive mice were given a final boost one week before splenic B-cell isolation. Mouse spleens were harvested and processed to recover total splenocytes. All procedures were carried out in accordance with protocol approved by IACUC.

To identify binders for CD137, six sorted mouse spleens were isolated and the recovered splenocytes were stained according to standard SBC Antibody Generation procedure. First, harvested splenocytes were depleted of T-cells using mouse pan-T Dynabeads (Invitrogen 114.43D) as per manufacturer's instructions. The depleted cell preparation was then incubated with 1 nM human CD137_huTNI-RSF9_Hu-His Cleavable_Tag_biotin (SEQ ID NO.335), and 1 nM MuGIPR-hu.FC-AF647, in conjunction with fluorochrome-conjugated antibodies against CD3, CD19, IgD, IgM, B220, and Sytox blue, included in the stain to aid the identification of live memory B-cells. Streptavidin-PE was added for detection of B cells binding biotinylated human CD137. Human CD137 antigen positive memory B-cells were then sorted singularly into 384-well plates and cultured for 7 days at 37° C. 5% CO2. The B-cell supernatants were screened for binding to biotinylated human and cynomolgus CD137 protein by AlphaLISA, as per manufacturer instructions.

To identify CD137 specific binders, those antibodies which reacted only to human Fc were removed using the counter Fc bait MuGIPR-hu.FC-AF647 and huCD137 bait huTNFRSF9_His-biotin; both showing good binding independently to the CD1 mouse B-cell splenocytes, FMO1 and FMO2 respectively. The double positive MuGIPR-hu.FC/huCD137 B-cells were completely separated from the Hu CD137 positive B cells in the fully stained sample. Thirty 384 well plates (10,560 wells) containing CD137 positive murine B cells were recovered and passed on for primary screening.

In the primary screen, 554 B-cell supernatants were assayed as positive for IgG>10 ng/ml with specific binding to both human CD137 with a S/B>2 and cynomolgus CD137 with a S/B>2 (FIG. 1). The 554 positive B-cell clones were separated into in six 96-well plates for recovery of DNA and isolation and amplification of the murine VH and VL gene segments. Of the 554 clones, 376 anti-CD137 expressing B cell clones with titers ranging from 0.6-75 ug/ml, were assayed for single point binding to recombinant CHO cells expressing human CD137 (CHO-K1). Of the 376 B cell clones, 168 B cell clones expressed anti-CD137 antibodies at a level >2× over background, with a range of 2-57× S/B (data not shown).

b. Identifying Agonist CD137 Antibodies

To identify agonist binders, a NF-kB-Luc2/4-1BB Jurkat assay system (Promega) was used. The NFkB activity assay uses a Jurkat reporter cell line expressing human CD137 on the cell surface.

Briefly, HTP supernatants containing recombinant IgG1 (KO) antibodies, were assayed by flow cytometry for binding to the NF-kB-Luc2/4-1BB Jurkat cell line. CD137 antibody controls were diluted in staining buffer including a CD137 positive control antibody, Urelumab (BMS). Supernatants taken from the 168 anti-CD137 B cell clones (50 µl) (discussed above) were incubated with Jurkat cells for 30 min at 4° C. in a 96 well plate. The cells were washed ×3 with staining buffer. A Goat F(ab')2 anti-human IgG-Fc PE secondary antibody was added to the cells and the plate was incubated for 30 min at 4° C. The cells were wash ×3 with staining buffer. Cells were suspended in 100 µl cold staining buffer and analyzed by flow cytometer. anti-CD137 antibody supernatants were analyzed for greater than 2× over background binding to the cell lines. Of the 168 screened anti-CD137 antibody containing supernatants, ten anti-CD137 supernatants displayed anti-CD137 agonist activity 1.5× over background (1.64-5.21×), with antibody titers ranging from 0.76-31 µg/ml. The signal from Clone CL-186330 was 5.61 S/B (data not shown).

c. V Gene Recovery for CD137 Binding Molecules

Ten B-cell clones identified as having agonist activity above a specific threshold selected for further analysis. First, cell lysates were harvested and re-arrayed into 96 well plates and stored at −20° C., before V-gene recovery. Genes encoding the mouse heavy and light chain variable regions were recovered by RT-PCR (See primers in Table 4), then cloned in-frame into pTT5 expression vectors encoding human IgG1 (KO) and κ constant regions, respectively.

B-cell lysates were subjected to cDNA synthesis using the Smarter cDNA synthesis kit (Clontech, Mount View, CA). To facilitate cDNA synthesis, oligo (dT) was used to prime reverse transcription of all messenger RNAs followed by "5' capping" with a Smarter IIA oligonucleotide. Subsequent amplification of the VH and VL fragments was performed using a 2-step PCR amplification using 5' primers targeting the Smarter IIA cap and 3' primers targeting consensus regions in CH1. Briefly, each 50µl PCR reaction consists of 1 µl each of 20 µM primers (forward and reverse, final concentration 1 µM), 25 µl of PrimeStar® Max DNA polymerase premix (Clontech), 2 µl of unpurified cDNA, and 20 µl of double-distilled H2O. The cycling program starts, followed by 35 cycles of 94° C. for 15 seconds, 50° C. for 30 seconds, 68° C. for 50 seconds, and ends at 68° C. for 7 min. The second round PCR was performed with VL and VH 2nd round primers containing 15 bp complementary extensions that "overlap" respective regions in their respective pTT5 mother vector (VH and VL). Second round PCR was performed with the following program: 35 cycles (94° C. for 45 seconds, 50° C. for 30 seconds, 68° C. for 50 seconds), and ends at 68° C. for 7 min.

To produce a chimeric CD137, the murine VH and VL regions were fused to the heavy and light chain constant regions from human IgG1, the In-Fusion® HD Cloning Kit (Clontech, U.S.A.) was used for directional cloning of VL gene into pTT5 huIgK vector (Clone ID 401064) and VH gene into pTT5 huIgG1KO vector (Clone ID 403776). To facilitate In-Fusion® HD Cloning, PCR products were purified and treated with Cloning Enhancer before In-Fusion® HD Cloning. Cloning and transformation were performed according to manufacturer's protocol (Clontech, U.S.A.). The DNA sequence of the subcloned gene V-gene fragments was confirmed by isolating mini-prep DNAs and subjecting isolated DNA to Sanger double stranded sequencing.

TABLE 5

| CLONING STEP | FORWARD PRIMER 5' → 3' | REVERSE PRIMER 5' → 3' |
| --- | --- | --- |
| Cloning mu VH into pTT5 vector | CTAATACGACTCACTATAGGGCAA GCAGTGGTATCAACGCAGAGT (SEQ ID NO.: 364) | GGGGCCAGTGGATAGACAGATGGG GG (SEQ ID NO.: 365) |

TABLE 5-continued

| CLONING STEP | FORWARD PRIMER 5' → 3' | REVERSE PRIMER 5' → 3' |
| --- | --- | --- |
| Cloning mu VL into pTT5 vector | CTAATACGACTCACTATAGGGCAA GCAGTGGTATCAACGCAGAGT (SEQ ID NO.: 366) | CTGCTCACTGGATGGTGGGAAGAT GG (SEQ ID NO.: 367) |
| 2nd round VH (pTT5 + 15) | TTAAACGGATCTCTAGCGAATTCA AGCAGTGGTATCAACGCAGAGT (SEQ ID NO.: 368) | TGGAGGAGGGTGCTAGCGGAAAGA CAGATGGGCCTTTCGTTGAGGCTG AGGA (SEQ ID NO.: 369) |
| 2nd round VL (pTT5 - 15) | TTAAACGGATCTCTAGCGAATTCA AGCAGTGGTATCAACGCAGAGT (SEQ ID NO.: 370) | GTTCCAGATTTCAATTGCTCATCG GATGGTGGGAAGATGAAGACAGAT GGTGCAGCAACAGTCCGTTTGAT (SEQ ID NO.: 662) | d. Tool CD137 Expressing Recombinant CHO Cell Lines:

The extracellular domains (ECD) for both human and cyno CD137 were cloned in pcDNA3.1 vector to drive high-level, constitutive expression in mammalian cell lines such as CHO-K1. This vector contains CMV promoter for high efficiency expression of proteins and a bovine growth hormone (BGH) polyadenylation signal and transcription termination sequence for enhanced mRNA stability. DNA sequences encoding the ectodomains of human, and cyno-molgus CD137 correspond to SEQ ID NOs: 1 and 2, respectively).

For stable clone production, CHO-K1 cells were seeded at the density of $0.25 \times 10^6$ cells per well in 6-well plate 24 hours before transfection in complete medium. Next day, 3 h prior to transfection medium was replenished with 1 mL of complete media. 2.5 μg DNA was diluted in DMEM medium in a total volume of 150 μL and 7.5 μL Lipofectamine® 2000 reagent (Life Technologies, Cat #11668-019) was diluted in 143 μL of DMEM medium. The diluted DNA was added to diluted Lipofectamine® 2000 reagent and incubated for 15 min After incubation, the DNA-lipid complexes were added to cells and further incubated for 48 hours. On hour post transfection, cells were trypsinized and selected in 1000 μg/mL G418 containing media (Life Technologies, Cat #10131-027). FACS analysis was done on pool after one week of selection in the presence of G418. Clones were selected on the basis of binding to human and cyno proteins, and used to screen hybridomas for those expressing CD137 antibodies e. Isolation and Characterization of Chimeric CD137 IgGs.

For the purposes of this invention a "humanized form" of an antibody, e.g., a non-human antibody, refers to an antibody that has undergone humanization. A "humanized" antibody refers to a chimeric antibody comprising amino acid residues from non-human HVRs and amino acid residues from human FRs. In certain embodiments, a humanized antibody will comprise substantially all of at least one, and typically two, variable domains, in which all or substantially all of the hypervariable regions (e.g., CDRs) correspond to those of a non-human antibody, and all or substantially all of the FRs correspond to those of a human antibody. A humanized antibody optionally may comprise at least a portion of an antibody constant region derived from a human antibody. A "humanized form" of an antibody, e.g., a non-human antibody, refers to an antibody that has undergone humanization. Other forms of "humanized antibodies" encompassed by the present invention are those in which the constant region has been additionally modified or changed from that of the original antibody to generate the properties according to the invention, especially in regard to C1q binding and/or Fc receptor (FcR) binding.

Chimeric, humanized antibodies were produced by transient transfection of CHO-E37 cells with the corresponding chimeric heavy and light chain-encoding pTT5 plasmids, wherein the murine variable regions from the parental anti-CD137 antibody were cloned in-frame with human constant regions, modified such that the Fc receptor further expresses the knock-out mutation L234A/L235A in the Fc portion to block the Fc R binding. Positive CD137 binding controls were likewise cloned in frame with human IgG constant regions, wherein VH and VL regions from Urelumab (VH, SEQ ID NO.:371; and VL, SEQ ID NO.:372) and Utulilomab (VH, SEQ ID NO.:373; and VL, SEQ ID NO.:374).

TABLE 6

| Antibody Name | VH | VL |
| --- | --- | --- |
| Urelumab (CAS#934823-49-1) | QVQLQQWGAGLLKPSETLS LTCAVYGGSFSGYYWSWIR QSPEKGLEWIGEINHGGYV TYNPSLESRVTISVDTSKN QFSLKLSSVTAADTAVYYC ARDYGPGNYDWYFDLWGRG TLVTVSS (SEQ ID NO.: 371) | EIVLTQSPATLSLSPGERATLS CRASQSVSSYLAWYQQKPGQAP RLLIYDASNRATGIPARFSGSG SGTDFTLTISSLEPEDFAVYYC QQRSNWPPALTFCGGTKVELK (SEQ ID NO.: 372) |

TABLE 6-continued

| Antibody Name | VH | VL |
|---|---|---|
| Utomilumab (CAS#1417318-27-4) | EVQLVQSGAEVKKPGESLR ISCKGSGYSFSTYWISWVR QMPGKGLEWMGKIYPGDSY TNYSPSFQGQVTISADKSI STAYLQWSSLKASDTAMYY CARGYGIFDYWGQGTLVTV SS (SEQ ID NO.: 373) | SYELTQPPSVSVSPGQTASITC SGDNIGDQYAHWYQQKPGQSPV LVIYQDKNRPSGIPERFSGSNS GNTATLTISGTQAMDEADYYCA TYTGFGSLAVFGGGTKLTVL (SEQ ID NO.: 374) |

CHO-E cells are transfected at 4×10⁶ cells/mL in Irvine media supplemented with 4 mM Glutamine in 50 mL Bioreactor tubes (Sigma). For a typical 35 mL transfection volume, pre-sterilized light chain (LC) plasmid DNA and heavy chain (HC) plasmid DNA (in a ratio of 2:1) are diluted in pre-sterilized 1 mL of OptiPRO™ SFM (Gibco) containing filler DNA. TransIT-PRO® (Mirus Bio LLC) transfection reagent is added to the DNA+Opti-PRO™ mix and immediately transferred to the prepared CHO-E cells, and the bioreactor tube is returned to the shaker at 37° C., 5% CO2 at 300 rpm. Twenty-four hours post transfection, the temperature is changed to 30° C. The transfected culture is maintained for 7 days. Culture harvest is completed by centrifugation at 4700 rpm for 25 minutes.

Purification of the chimeric CD137 IgG antibody molecules from culture supernatants was carried out by affinity chromatography using Protein A sensor tips in a ForteBio's Octet® RED96 instrument (ForteBio). To test whether the isolated CD137 antibodies were able to cross-react with human and cynomolgus monkey cells, the chimeric anti-human CD137 IgG1 (KO) antibodies, were assayed to generate FLOW cytometry binding curves and EC50 values against the CHO-Human CD137 and CHO-Cyno CD137 overexpressing cell lines. Briefly, chimeric CD137 IgG antibodies and positive IgG controls were diluted in staining buffer to generate 12-point dilution curves. Cells and antibodies were incubated for 30 minutes at 4° C. in a 96 well plate. The cells were wash 3× with staining buffer. A Goat F(ab') 2 anti-human IgG-Fc PE secondary antibody was added to the cells and the plate incubated for 30 min at 4° C. The cells were washed 3× with staining buffer. Cells were suspended in 100 μl cold staining buffer and analyzed by flow cytometer. The binding curves were analyzed and the EC50 for the anti-human CD137 antibodies was calculated.

Twenty-seven hits were identified from first round of selection and additional screening provided 18 more hits which were labeled as "B" indicating a different selection pool. See Table 7.

TABLE 7

| Antibodies | Human CD137 EC50 | Cyno CD137 EC50 | VH | VL |
|---|---|---|---|---|
| Urelumab | 0.07185 | | SEQ ID NO.: 371 | SEQ ID NO.: 372 |
| Utomilumab | 0.5884 | 0.6093 | SEQ ID NO.: 373 | SEQ ID NO.: 374 |
| CD137 #A1 | 0.8411 | 1.543 | QVQLVQSGAEVKKPGASVKVSCKASGYTLTNYPMH WVRQAPGQRPEWMGWSNAGNGNTKYSQEFQDRVTI TRDTSASTAYMELSSLRSEDMAVYYCTREGVTGGF DIWGQGTMVTVSS (SEQ ID NO.: 375) | DIVMTQSPLSLPVTPGEPASISCRSSQSLLHSIGY NYLDWYLQKPGQSPQLLIFLGSNRASGVPDRFSGS GSGTDFTLKISRVEAEDVGVYYCMQALQTVTFGQG TRLEIK (SEQ ID NO.: 376) |
| CD137 #A2 | 0.9237 | 1.709 | QVQLVQSGADVKKPGASVRVSCKASGYTFTSYPIH WVRQAPGHRLEWMGWSNAGIGNAKYSQEFQGRVTI TRDTSASTAYMDLSSLTSEDLAVYYCAREGVAGAF DIWGQGTMVTVSA (SEQ ID NO.: 377) | DIVMTQSPLSLPVTPGEPASISCRSSQNLLHSNGY NYLDWYLHKPGQSPQLLIYLGSIRASGVPDRFSGS ESGTDFTLKISRVEAEDVGIYYCMQPLQIPYTFGQ GTKLELK (SEQ ID NO.: 378) |
| CD137 #A3 | 1.757 | 2.32 | DVQLQESGPGLVKPSQSLSLTCTVTGYSITSDYGW NWIRQFPGNKVEWMGYISYSGSTSYNPSLKSRISI TRDTSKNQFFLQLKSVTTEDTATYYCARSDPYYGI SWFAYWGQGPLVTVSA (SEQ ID NO.: 379) | DIQMTQTTSSLSASLGDRVTISCRASQDISNFLNW YQQKPDGTVKLLIYYTSRLHSGVPSRFSGSGSGTD YSLTISNLEQEDIATYFCQQSHTLPWTFGGGTKLE IK (SEQ ID NO.: 380) |
| CD137 #A4 | 1.604 | 1.826 | DVQLQESGPGLVKPSQSLSLTCTVTGYSITSDYVW NWIRQFPGNKLEWMGYISYSGGTRYNPSLKSRISI TRDTSENQFFLQLDSVTTEDTATFYCARSGNWDWY FDAWGTGTTVTVSS (SEQ ID NO.: 381) | DIQMTQTTSSLSASLGDRVTISCRPSQDISNYLDW YQQKPDGTVKLLIYSTSRLPSGVPSRFSGSGSGTD YSLTISNMEQEDIATYFCQQGNTFPPTFGGGTKLE IK (SEQ ID NO.: 382) |
| CD137 #A5 | 0.5051 | 0.7689 | DVQLQESGPDLVKPSQSLSLTCTVTGYSITSGFNW HWIRQFPGNKLEWMGYIHNSGSTNYNPFLKSRISI TRDTSKNQFFLQLNSVTTEDTATYYCARGALGTMD YWGQGTSVTVSS (SEQ ID NO.: 383) | DIVLTQSPASLAVSLGQRATISCEASQSLDYDGDS YMHWFQQKPGQPPKLLIYVASNLESGIPARFSGSG SGTDFTLNIHPVEEEDAATYYCQQSNEDPWTFGGG TKLEIK (SEQ ID NO.: 384) |
| CD137 #A6 | 2.216 | 2.959 | DVQLQESGPGLLKPSQSLSLTCTVTGYSITSDYVW SWIRQFPGNKLEWMGYINYSGGTSYNPSLKSRISI TRDTSKNQFFLQLNSVTTEDTATYYCTRSGNWDWY FDVWGTGTTVTVSS (SEQ ID NO.: 385) | DIQMTQTTSSLSASLGDRVTISCRASQDIRNNLNW FQQKPDGTVKLLIYYTSRLHSGLPSRFSGSGSGTD YSLTISNLEQEDFATYFCQQGNTLPPTFGGGTKLE IK (SEQ ID NO.: 386) |

TABLE 7-continued

| Antibodies | Human CD137 EC50 | Cyno CD137 EC50 | VH | VL |
|---|---|---|---|---|
| CD137 #A8 | 0.4958 | 0.7561 | DVQLQESGPDLVKPSQSLSLTCTVTGYSITSGYNW HWIRQFPGNKLEWMGYIHYSGSTNYNPSLKSRISI TRDTSKNQFFLQLNSVTTEDTATYYCARGALGAMD YWGQGTSVTVSS (SEQ ID NO.: 387) | DIVLTQSPASLAVSPGQRATISCKASQSVDYDGDS YMNWYQQKPGQPPKLLIYVASNVESGIPARFSGSG SGTDFTLNIHPVEEEDAATYYCQQSNEDPWTFGCG TKLEIK (SEQ ID NO.: 388) |
| CD137 #A12 | 0.4694 | 1.941 | QVQLKQSGPGLVQPSQSLSITCTVSGFSLTSHGVH WVRQSPGKGLEWLGVIWSGGYTDYNAAFISRLSIS TDNSKSHIFFKMNSLQADDTAIYYCARNGASYYYA MDYWGQGTSVTVSS (SEQ ID NO.: 389) | DIVMTQAAFSNPVTLGISASISCRSSKSLLHSNGI TYLYWYLQKPGQSPQLLIYQMSNLASGVPDRFSSS GSGTDFTLRISRVEAEDVGVYYCAQNLELPLTFGA GTKLELK (SEQ ID NO.: 390) |
| CD137 #A13 | 3.722 | 3.832 | EVQLQQSGAELVKPGASVKLSCTASGFNIKDTYIH WVRQRPEQGLEWIGRIDPANGNTIYASKFQGKATI TADTSSNTAYMQLSSLTSGDTAVYYCVRLDLLNYW GQGTTLTVSS (SEQ ID NO.: 391) | DIKMTQSPSSMYASLGERVTITCKASQDIATYLSW FQQKPGKSPKTLIYRTNGLLDGVPSRFSGSGSGQD YSLTISSLEYEDMGIYYCLQYDEFPFTEGGCTKLE IK (SEQ ID NO.: 392) |
| CD137 #A16 | 0.8612 | 0.8407 | QVQLQQPGAELVKPGASVKLSCKASGYTFTNFWIN WVKQRPGQALEWIGNIYPGNDNTNYNGNFKTKATL TVDRSSSTAYMHLSSLTSKDSAVYYCARGQLGLDY WGQGTTLTVSS (SEQ ID NO.: 393) | DILLTQSPAILSVSPGERVSFSCRASQNIGTTIHW YHQRTNGSPRLLIKFASESISGIPSRFSGSGSGTD FTLSINSVESEDFADYYCQQSNSWPFTEGSGTKLE IK (SEQ ID NO.: 394) |
| CD137 #A17 | 0.2129 | 0.2661 | QVQLQQPGAELVKPGASVKLSCKASGYTFTNFWIN WVKQRPGQALEWIGNIYPGNDNTNYNGNFKSKATL TVDRSSSTAYMHLSSLTSKDSAVYYCARGQLGLDY WGQGTTLTVSS (SEQ ID NO.: 395) | DILLTQSPAILSVSPGERVSFSCRASQNIGTAIHW YHQRTNGSPRLLIKFASESISGIPSRFSGSGSGTD FTLSINSVESEDFADYYCQQSNSWPFTFGSGTKLE IK (SEQ ID NO.: 396) |
| CD137 #A19 | 1.052 | 1.226 | DVQLVESGGDLVQPGGSRKLSCAASGFTESSEGMH WVRQAPERGLEWVAYISSGSSTIYYADTVKGRFII SRDNPKNTLFLQMTSLRSEDTAMYYCARDWVDYWG QGTSVTVSS (SEQ ID NO.: 397) | DVLMTQTPLSLPVSLGDQASISCRSSQNIVHGNGN TYLEWYLQKPGQSPKLLIYQVSNRFSGVPDRFSGS GSGTDFTLKISRVEAEDLGVYYCFQGSHVPRTFGG GTKLEIK (SEQ ID NO.: 398) |
| CD137 #A25 | 3.704 | 2.758 | DVQLVESGGGLVQPGGSRKLSCAASGFSFSSFGMH WVRQAPEKGLEWVAYISSGSSTIYYADTVKGRFTI SRDNPKNTLFLQMTSLRSEDTAMYYCVRDWTDYWG QGTTLTVST (SEQ ID NO.: 399) | QIVLTQSPAIMSASLGEEITLTCSATSSVSYMHWS QQKSGTSPKLLIYTTSNLASGVPSRFSGSGSGTFY SLTISSVEAEDAADYYCHQWTTYPWTFGGGTKLEI K (SEQ ID NO.: 400) |
| CD137 #A26 | 1.499 | 1.916 | EVQLQESGPSLVKPSQTLSLTCSVTGDSITSGYWN WNRKFPGNKFEYMGYISYSDSAYYNPSLKSRSIT RDTSKNQYYLQLNSVTTEDTATYYCTRWGIPFAFW GQGTLVTVSA (SEQ ID NO.: 401) | DIKMTQSPSSMYASLGERVTITCKASQDIDSYLYW FQQKPGKSPETLIYHANRLVDGVPSRFSGSGSGQD YSLTISSLEYEDMGIYYCLQYDEFPYTFGGGTKLE IK (SEQ ID NO.: 402) |
| CD137 #A27 | 0.9805 | 1.219 | QVQLQQSGAELTRPGASVKLSCKASGYTFTNYWIQ WIKQRPGQGLEWIGTIYPENGDTRYTQKFKGKATL TADKSSSTAYMQLSSLASEDSAVYYCARGLLEGAH YWCrQGTTLTVSS (SEQ ID NO.: 403) | DILLTQSPAILSVSPGERVSFSCRASQSIGASIHW YQQRTNGSPRLLIKFSSESISGIPSRFSGSGSGTD FTLTINSVESEDIADYYCQQTNSWPTAFGGGTKLE MK (SEQ ID NO.: 404) |
| CD137 #A30 | 1.181 | 2.358 | QVQLQQPGTEFVKPGASVKLSCKASDYTFTSHWMH WVKQRPGQGLEWIGEIDPSDSYTNYIQKFKGKATL TVDKSSSTAYMQLSSLTSEDSAVYYCARGDYYGTR YFDVWGAGTTVIVSS (SEQ ID NO.: 405) | DIVMTQSPSSLSVSAGEKVTMSCKSGQNLFNSGNQ KNYLAWYQQKPGQPPRLLIYGASTRESGVPDRFTG SGSGTDFTLTISSVQAEDLAVYYCQNDQSYPPTFG AGTKLELK (SEQ ID NO.: 406) |
| CD137 #A39 | 1.328 | 1.182 | QVQLQQSGAELMKPGSSVKLSCKAPGYKFTDYWIE WVKQRPGHGLDWIGNILPGTINTNSNENFKGKATF TADTSSNTAYMQLSSLTSEDSAVYYCARRSLEYYF DYWGQGTTLTVSS (SEQ ID NO.: 407) | DIVVTQSPASLAVSLGQRATISCRASQSVSTSRYS YMHWYQQKPGQPPRLLINYASNLESGVPARFSGSG SGTDFTLNIHPVEEEDTATYYCQHTWEIPWTEGGG TKLEIK (SEQ ID NO.: 408) |
| CD137 #A41 | 3.507 | 4.757 | QVQLQESGPGLVKPSETLSLNCTVSGGSISNYYWS WIRQPAGKGLEWIGRIYTSGNTNYNPSLKSRVTMS VDTSKNQFSLKLTSVTAADTAVYYCARDGNWNYAD AFDIWGQGTMVTVSS (SEQ ID NO.: 409) | DIQMTQSPSSVSASVGDRVTITCRASQGISSWLAW FQQIPGKAPKLLIYTASGLQSGVPSRFSGSGSGTD FTLTISSLQPEDFATYYCQQTNSFPPFTEGPGTKVD IK (SEQ ID NO.: 410) |
| CD137 #A42 | 0.4829 | 0.7372 | QVQLQQSGPGLVKPSQTLSLTCAISGDSVSSNSAA WNWIRQSPSRGLEWLGRTYYRSNWYNDYAVSVESR ITIKPDTSKNQFSLQLNSVTPEDTAVYYCARMDSG TYLDAFDIWGQGTMVTVSS (SEQ ID NO.: 411) | EIVMTQSPATLSVSPGERATLSCRASQSVGRNLAW YQQKPGQTPRLLIYGASTRATGIPAIFSGSGSGTE FTLTISSLSEDFAVYYCQQYNYWPPFTFAQGTKL EIK (SEQ ID NO.: 412) |
| CD137 #A44 | 0.7133 | 1.187 | QVQLVQSGAEVKKPGASVKVSCKASGYTFTNYPIH WVRQAPGQRLEWMGWSNAGNGNTKYSPEFQDRVTI TRDTSASTVYMELSSLRSEDMSVYYCAREGVTGAF DIWGQGTMVTVSS (SEQ ID NO.: 413) | DIVMTQSPLSLPVTPGEPASISCRSSQSLLHSIGY NYLDWYLQKPGQSPQLLIYLGSYRASGVPDRFSGS GSGTDFTLKISRVEAEDVGVYYCMQALQTPLTFGG GTKVEIK (SEQ ID NO.: 414) |
| CD137 #A45 | 1.207 | 2.089 | QVQLVQSGAEVKKPGASVKVSCKASGYIFTNYPMH WVRQAPGQRLEWMGWSNAGIGNTKYSQDFQGRVTI TRDTSANTSYMELSSLRSEDMAVYYCAREGVTGAF DYWGQGTLVTVSS (SEQ ID NO.: 415) | DIVMTQSPLSLPVTPGEPASISCRSSQSLLHSNGF NYLDWYLQKPGQSPQLLIFLGSIRASGVPDRFSGS ESGTDFTLKISRVEADDVGIYYCMQPLQIPYTFGQ GTKLEIK (SEQ ID NO.: 416) |

TABLE 7-continued

| Antibodies | Human CD137 EC50 | Cyno CD137 EC50 | VH | VL |
|---|---|---|---|---|
| CD137 #A46 | 1.023 | 1.714 | QVQLAQSGAEVKKPGASVKVSCKASGYTFSSFPMH WVRQAPGQRLEWMGWSNAGIGNTKYSQEFQGRVTI TRDTSASTAYMELSSLRSEDMAVYYCAREGLTGAF DYWGQGTLVTVSS (SEQ ID NO.: 417) | DIVMTQSPLSLPVTPGEPASISCRSSQSLLHSNGY NYLGWHLQKPGQSPQLLIYLGSYRASGVPDRFSGS GSGTDFTLKISRVEAEDVGVYYCMQPLQIPLTFGG GTKVEIK (SEQ ID NO.: 418) |
| CD137 #A47 | 0.5654 | 1.402 | QVQLAQSGAEVKKPGASVKVSCKASGYTESSFPMH WVRQAPGQRLEWMGWSNAGIGNTKYSQEFQGRVTI TRDTSASTAYMELSSLRSEDMAVYYCAREGLTGAF DYWGQGTLVTVSS (SEQ ID NO.: 419) | DIVMTQSPLSLPVTPGEPASISCRSSQSLLHSNGY NYLGWYLQKPGQSPQLLIYLGSYRASGVPDRFSGS GSGTDFTLKISRVEAEDVGVYYCMQPLQIPLTFGG GTKVEIK (SEQ ID NO.: 420) |
| CD137 #A49 | 17.07 | 25.5 | QVQLQESGPGLVKPSETLSLTCTVSGGSISSYYWS WIRQPPGKGLEWIGYIYYSGSTNYNPSLKRVTIS VDTSKNQFSLKLSSVTAADTAVYYCARDQSGGGSF QHWGQGTLVTVSS (SEQ ID NO.: 421) | EIVMTQSPLSLPVTPGEPASISCRSSQSLLYSNGY NHLDWYLQKPGQSPQLLIYLGSNRASGVPDRFSGS GSGTDFTLKISRVEAEDVGVYYCMQALQTPPTFGQ GTKLEIK (SEQ ID NO.: 422) |
| CD137 #A50 | 1.408 | 1.405 | QVTLKESGPVLVKPTETLTLTCTVSGFSLSNARVG VSWIRQPPGKALESLVHIFSNDEKFFSTSLKSRLT ISKDTSKSQVVLTMTNMVPVDTATYYCARNGGFGV IIHDAFDIWGQGTMVTVSS (SEQ ID NO.: 423) | DIQLTQSPSFLSASVGDRVTITCRASQGISSYLAW YQQKPGKAPKLLIFAASTLQNGVPSRFSGSGSGTE FTLTISSLQPEDFATYYCQQLNNYPRTFGQGTKVE IK (SEQ ID NO.: 424) |
| CD137 #A51 | 505 | | EVQLLESGGGLIQPGGSLRLSCAASGFTESSYAMR WVRQAPGKGLEWVSDISGSGGSTFYADSVKGRFTI SRDNSKNTLFLQMNSLRAEDTAVYYCAKEGGTHYY FFGMDVWGQGTTVTVSS (SEQ ID NO.: 425) | DIQLTQSPSFLSASVGDRVTITCRASQGISSYLAW YQQKPGKAPKLLIYAASSLQNGVPSGFSGSGSGTE FTLTISSLQPEDFATYYCQQFNSYPLTFGGGTKVE IK (SEQ ID NO.: 426) |
| CD137 #A57 | 1.115 | 2.02 | QVQLVQSGAEVKKPGASVKVSCKTSGYTFTSYPMH WVRQAPGQRLEWMGWSNAGNGNTKYSQEFQGRVTL TRDTSASTAFMELSSLRSEDMAVYYCAREGLTGAF DYWGQGTLVTVSS (SEQ ID NO.: 427) | DIVMTQSPLSLPVTPGEPASISCRSSQSLLHSNGY NYLDWYLQKPGQSPQLLIYLGSNRASGVPDRFSGS GSGTDFTLKISRVEAEDVGVYYCMQPLQTPYTFGQ GTKLEIK (SEQ ID NO.: 428) |
| CD137 #B1 | 0.8 | 0.9838 | QVQLQQPGAELVKPGASVKLSCKASGYTFTNFWIN WVKQRPGQALEWIGNIYPGNDNTNYNGNEKTKATL TVDRSSSTAYMHLSSLTSKDSAVYYCARGQLGLDY WGQGTTLTVSS (SEQ ID NO.: 429) | DILLTQSPAILSVSPGERVSFSCRASQNIGTTIHW YHQRTNGSPRLLIKFASESISGIPSRFSGSGSGTD FTLSINSVESEDFADYYCQQSNSWPFTEGSGTKLE IK (SEQ ID NO.: 430) |
| CD137 #B2 | 0.6494 | 0.9156 | QVQLQQPGAELVKPGASVKLSCKASGYTFTNFWIN WVKQRPGQGLEWIGNIYPGNTGTNYNERFKTKATL TVDISSSTAYMRLSSLTSEDSAVYYCARGQLGLDY WGQGTTLTVSS (SEQ ID NO.: 431) | DILLTQSPAILSVSPGERVSFSCRASQIIGTTIQW YQQRTNGSPRLLIKYASESLSGIPSRFSGSGSGTD FTLSINNVESEDIADYYCQQSHSWPFTFGSGTKLE IK (SEQ ID NO.: 432) |
| CD137 #B3 | 0.9614 | 1.243 | DVQLVESGGDLVQPGGSRKLSCAASGFTFSSFGMH WVRQAPERGLEWVAYISSGGSTIYYADTVKGRFII SRDNPKNTLFLQMTSLRSEDTAMYYCARDWVDYWG QGTSVTVSS (SEQ ID NO.: 433) | QIVLTQSPAIMSASPGEKVTITCSASSSVNYIHWF QQKPGTSPKLWIYSTSNLASGVPARFSGRGSGTSY SLTISRMEAEDAATYYCLQGSSYPWTFGGGTKLEI K (SEQ ID NO.: 434) |
| CD137 #B4 | 0.661 | 0.9905 | DVQLQESGPGLVKPSQSLSLTCTVTGYSITSDYAW NWIRQFPGNRLEWMGYISYSGSTSYNPSLKSRISI TRDTSKNQFFLQLNSVTTEDTATYFCARWGYVLDY WGQGTSVTVSS (SEQ ID NO.: 435) | DIVMTQSHKFMSTSEGDRVSITCKASQDVSTAVAW YQQKPGQSPKLLIYWASTRHTGVPDRFRGSGSGTD YTLTISSVQAEDLALYFCQQHYFTPYTEGGGTKLE IK (SEQ ID NO.: 436) |
| CD137 #B5 | 1.203 | 1.154 | QVQLQQSGAELMKPGASVKISCKATGYTFSSYWLF WIKQRPGHGLEWIGEILPGSGVSNYNEKFKGKATF TANTSSNTAYMQLSSLTSEDSAVYYCARLGLAWFA YWGQGTLVTVSA (SEQ ID NO.: 437) | DVLMTQTPLSLPVSLGDQASISCRSSQNIVHGNGN TYLEWYLQKPGQSPKLLIYQVSNRFSGVPDRFSGS GSGTDFTLKISRVEAEDLGVYYCFQGSHVPRTFGG GTKLEIK (SEQ ID NO.: 438) |
| CD137 #B7 | 0.4523 | 0.5996 | EVQLQESGPSLVKPSQTLSLTCSVTGDSITSGYWN WIRKFPGNKLEFMGYITYSGSTYYNPSLKRSRISIT RDTSRNQFYLQVNSVTTEDTATYFCTRYYYYGSTY YAMDYWGQGTSVTVSS (SEQ ID NO.: 439) | NIVLTQSPASLAVSLGQRATISCRVSESVDSYGNS FMHWFQQKPGQSPKLLIYLASNLESGVPARFSGSG SRTDFTLTIDPVEADDAATYYCQQNIEDPPTFGGG TKLEIK (SEQ ID NO.: 440) |
| CD137 #B9 | 0.8907 | 1.336 | QVQLVQSGAEVKKPGASVKVSCKASGYTLTNFPMH WVRQAPGQRLEWMGWTNAGNGNTKYSQELQGRVTM TRDTSASIAYMELSSLRSEDMGVYYCAREGLTGAF DYWGQGTLVTVSS (SEQ ID NO.: 441) | DIVMTQSPLSLPVTPGDPASISCRSSQSLLHSNGY NYLDWYLQKPGQSPQLLIYLGSNRASGVPDRFSGS GSGTDFTLKISRVEAEDVGVYYCMQPLQSPYTFGQ GTKLEIK (SEQ ID NO.: 442) |
| CD137 #B10 | 0.5016 | 0.7838 | QVQLVQSGAEVKKPGASVKVSCKASGYTFTNYPMH WVRQAPGQRLEWMGWSNAGSGNTKYSQDFQGRVSI TRDTSASTAYMELSSLKSEDMAIYYCAREGVAGAF DIWGQGTVVTVSS (SEQ ID NO.: 443) | DIVMTQSPLSLPVTPGEPASISCRSSQRLLHSNGF NYLGWYLQKPGQSPQLLIYLGSHRASGVPDRFSGS GSGTDFTLKISRVEAEDVGVYYCMQPLQIPYTFGQ GTKLEIK (SEQ ID NO.: 444) |
| CD137 #B12 | 0.4628 | 0.7299 | QVQLVQSGAEVKKPGASVKVSCKASGYTFTTYPMH WVRQAPGQRLEWMGWSNAGIGNTKYSQEFQDRITI SRDTSASTVYMELSSLRSEDMAVYYCAREGVAGGF DIWGQGTMVTVSS (SEQ ID NO.: 445) | DIVMTQSPLSLPVTPGEPASISCRSSQSLLHSNGY NYLNWYLQKPGQSPQLLIYLGSIRASGVPDRFSGS ESGTDFTLKISRVEAEDVGVYYCMQPLQIPYTFGQ GTKLEIK (SEQ ID NO.: 446) |

TABLE 7-continued

| Antibodies | Human CD137 EC50 | Cyno CD137 EC50 | VH | VL |
| --- | --- | --- | --- | --- |
| CD137 #B13 | 0.5625 | 0.6321 | QVQLQQPGAELVKPGASVKLSCKASGYTFTNFWIN WVKQRPGQALEWIGNIYPGNDNTNYNGNFKTKATL TVDRSSSTAYMHLSSLTSKDSAVYYCARGQLGLDY WGQGTTLTVSS (SEQ ID NO.: 447) | DILLTQSPAILSVSPGERVSFSCRASQNIGTTIHW YHQRTNGSPRLLIKFASESISGIPSRFSGSGSGTD FTLSINSVESEDFADYYCQQSNSWPFTFGSGTKLE IK (SEQ ID NO.: 448) |
| CD137 #B17 | 0.5524 | 0.9314 | EVQLQQSGPELVKPGASVKMSCKASGYTFTYYVMH WVKQRPGQGLEWIGYINPYNDGTKYNEKFKGKATL TSDKSSSTAYMELSSLTSEDSAVYYCAPGSVDYWG QGTTLTVSS (SEQ ID NO.: 449) | DIVMTQSQKFMSTSVGDRVSITCKASQNVGTSVAW YQQKSGHSPKLLIYSASNRNTGVPDRFTGSGSGTD FTLTISNMQSEDLADYFCQQYSTYPLTFGSGTKLE IK (SEQ ID NO.: 450) |
| CD137 #B19 | 3.359 | 5.973 | QVQLKQSGPGLVPPSQSLSITCTVSGFSLSSYGVH WVRQSPGKGLEWLGVIWSGGNTDFNAAFVSRLSIS TEISESQVFFRMNSLQADDTAIYYCARNGPQYYFA MDYWGQGTSVTVSS (SEQ ID NO.: 451) | DIVLTQSPASLTVSLGQRATISCRANKSVSTSGYS YMHWHQQKPGQPPKLLIYLASNLESGVPARFSGSG SGTDFTLNIHPVEEEDAATYYCQHSRELPLTFGAG TKLELK (SEQ ID NO.: 452) |
| CD137 #B20 | 0.4371 | 0.4445 | EVKLVESEGGLVQPGSSMKLSCTASGFTFSDFYMA WVRQVPEKGLEWVANINYDGSSTYYLDSLKSRFII SRDNARNILYLQMSSLKSEDTATYYCAREGDEGWY FDVWGAGTTVTVSS (SEQ ID NO.: 453) | DIVMTQSHKFMSTSVGDRVSITCKASQDVSTAVAW YQQKPGQSPKLLIYSASYRYTGVPDRFTGSGSGTD FTFTISSVQAEDLAVYYCQQHYSNPWTFGGGTKLE IK (SEQ ID NO.: 454) |
| CD137 #B21 | 0.329 | 0.4193 | EVKLVESEGGLVQPGSSMKLSCTASGFTFSDFYMA WVRQVPEKGLEWVANINYDGSSTYYLDSLKSRFII SRDNARNILYLQMSSLKSEDTATYYCAREGDEGWY FDVWGAGTTVTVSS (SEQ ID NO.: 455) | DIVMTQSHKFMSTSVGDRVSITCKASQDVSTAVAW YQQKPGQSPKLLIYSASYRYTGVPDRFTGSGSGTD FTFTISSVQAEDLAVYYCQQHYSNPWTFGGGTKLE IK (SEQ ID NO.: 456) |
| CD137 #B27 | 1.65 | 2.087 | QVQLQQSGAELVRPGASVKISCKAFGYTFTNHHIN WVKQRPGQGLDWIGYINPYNDYSGYNQKFKGRATL TVDKSSNTAYMELSSLTSEDSAVYYCATPGTWEGY YFDYWGQGTTLTVSS (SEQ ID NO.: 457) | DVVMTQTPLSLPVSLGDQASISCRSSQSLVHSNGN TYLEWYLQKPGQSPKVLIYMVSNRFSGVPDRFSGS GSGTDFTLKISRVEAEDLGVYYCFQGSHIPLTFGA GTKLELK (SEQ ID NO.: 458) |
| CD137 #B28 | 0.8215 | 0.9396 | QVQLQQSGPQLIRPGASVKISCKASGYSFTGYWIH WVKQRPGQGLEWIGMIDPSDSETRLNQKFKDKATL TVDKSSTTAYMQLSSPTSEDSAVFYCARYRNYGYD GFAHWGQGTLVTVSA (SEQ ID NO.: 459) | DIVMTQSPSSLTVTAGEKVTMSCKSSQSLLNSGNE KNYLAWYQQKPGQPPKLLIYWASTRESGVPDRFTG SGSGTDFTLTISSVQTEDLAVYHCQNDYSLPLTFG AGTKLELK (SEQ ID NO.: 460) |
| CD137 #B30 | 0.725 | 0.9285 | QVQLQQSGPQLIRPGASVKISCKASGYSFTGYWIH WVKQRPGQGLEWIGMIDPSDSETRLNQKFKDKATL TVDKSSTTAYMQLSSPTSEDSAVFYCARYRNYGYD GFAHWGQGTLVTVSA (SEQ ID NO.: 461) | DIVMTQSPSSLTVTAGEKVTMSCKSSQSLLNSGNE KNYLAWYQQKPGQPPKLLIYWASTRESGVPDRFTG SGSGTDFTLTISSVQTEDLAVYHCQNDYSLPLTFG AGTKLELK (SEQ ID NO.: 462) |
| CD137 #B31 | 0.8772 | 1.178 | QVQLQQSGPQLIRPGASVKISCKASGYSFTGYWIH WVKQRPGQGLEWIGMIDPSDSETRLNQKFKDKATL TVDKSSTTAYMQLSSPTSEDSAVFYCARYRNYGYD GFAHWGQGTLVTVSA (SEQ ID NO.: 463) | DIVMTQSPSSLTVTAGEKVTMSCKSSQSLLNSGNE KNYLAWYQQKPGQPPKLLIYWASTRESGVPDRFTG SGSGTDFTLTISSVQTEDLAVYHCQNDYSLPLTFG AGTKLELK (SEQ ID NO.: 464) |

As shown in Table 7 (above), almost all anti-human CD137 binding clones were cross-reactive with cynomolgus CD137 expressed on recombinant CHO cells as well as binding the CHO cell line expressing human CD137 as demonstrated by comparable EC50 values.

f. Functional Properties of Chimeric Anti-CD137 IgG1 Binding Clones

CD137 is a known co-stimulatory receptor and improves expansion, cytokine production and functional properties of T cells when it is expressed on activated cells. In nature, activation of cells induces up-regulation of CD137 on T cells (Pollok et al, (1993) J. Immunol. 150(3): 771-781) and supports after engagement the immune response by boosting expansion and cytokine release (Flurtado et al. (1995) J Immunology 155(7), 3360-3367). Cross-linking CD137 in the context of activated T cells is expected to enhance T cell activation and lead to an expansion and recruitment of T cells.

To evaluate the CD137 antibody agonistic behavior, a secondary antibody was used to cross-link CD137 on the cell surface. The rationale was to identify anti-CD137 antibodies, which were agonist only when they were cross-linked with the objective of identifying molecules that are agonistic only when in combination as a bispecific molecule with FAP.

To achieve this, 72 nM of each of the anti-CD137 antibody was incubated with a 2.5× molar excess of cross-linking antibody (+CL) and without the cross-linking antibody (−CL), for 30 minutes at 37° C. The anti-CD137 antibody supernatants or the actual antibody was diluted to approximately 48 nM by adding 220.5 µl media to each tube. The antibody mixture was serial-diluted in 80 µl of 160 µl media (RPMI media/1% FBS). 50 µL (0.8×10 5 cells) cells were mixed with 25 µL of diluted antibody together in a flat bottom 96 well plate (3× antibody dilutions were made for a total of 9 data points each). The cells were incubated with the anti-CD137 antibodies for 5 hours at 37° C. and 5% $CO_2$. Detection of activity was achieved by the addition of 75 µl of Bio-Glo™ Luciferase assay reagent (G7940 Promega) and the resulting luminescence was measured with the EnVision® Plate Reader (Perkin-Elmer).

CD137 dependent engagement and cross-linking can induce a NFκB-mediated luciferase activation in the Jurkat reporter cell line. Anti-CD137 agonistic binding curves and $EC_{50}$ values were generated. Binding activity data was plotted as curve (FIGS. 3A and 3B) and the luciferase activity data (RLU) (FIGS. 3C and 3D) was plotted as a bar graph. Two positive controls based on known CD137 binders (Urelumab (BMS anti-CD137 Ab) and Utomilumab (Pfizer anti-CD137 Ab)) were compared to the novel CD137 binder of the invention. On the basis of agonistic activity in NFkB-Jurkat assays, candidates CD137 #B21 (also referred to as "CD137 #1" referring to the parent) and CD137 #A49 (also referred to as "CD137 #7" referring to the parent) were selected for further optimization.

g. Generation of Chimeric Fab for Lead Candidate CD137 Antibodies (CD137 #1)

Known techniques are used to mirror affinity maturation and hypermutation events that occur randomly in nature in vivo to improve the affinity of antibody for the antigen. Such modifications include, for example, deletions from, and/or insertions into and/or substitutions of residues within the amino acid sequences of the antibody. Any combination of deletion, insertion, and substitution can be made to arrive at the final construct, provided that the final construct possesses the desired characteristics, e.g., antigen-binding. Sites of interest for substitutional mutagenesis include the hypervariable regions (CDRs) and framework regions (FW). Affinity, avidity, stability, solubility, glycosylation, are a few characteristics that are considered to optimise candidate CD137 binders.

The term "amino acid sequence variants" includes substantial variants wherein there are amino acid substitutions in one or more hypervariable region residues of a parent antigen-binding molecule (e.g. a chimeric, humanized, or human antibody). Generally, the resulting variant(s) selected for further study will have modifications (e.g., improvements) in certain biological properties (e.g., increased affinity, reduced immunogenicity) relative to the parent antigen binding molecule and/or will have substantially retained certain biological properties of the parent antigen binding molecule. An exemplary substitutional variant is an affinity matured antibody, which may be conveniently generated, e.g., using phage display-based affinity maturation techniques such as those described herein. Briefly, one or more variable region residues are mutated, and the variant antigen binding molecules displayed on phage and screened for a particular biological activity (e.g. binding affinity). In certain embodiments, substitutions, insertions, or deletions may occur within one or more hypervariable regions so long as such alterations do not substantially reduce the ability of the antigen binding molecule to bind antigen. For example, conservative alterations (e.g., conservative substitutions as provided herein) that do not substantially reduce binding affinity may be made in hypervariable regions. Further substitutions may be introduced at the amino acid locations demonstrating functional sensitivity to the initial substitutions. Alternatively, or additionally, a crystal structure of an antigen-antigen binding molecule complex to identify contact points between the antibody and antigen. Such contact residues and neighboring residues may be targeted or eliminated as candidates for substitution. Variants may be screened to determine whether they contain the desired properties.

An "affinity matured" antibody refers to an antibody with one or more alterations in one or more hypervariable regions, compared to a parent antibody which does not possess such alterations, such alterations resulting in an improvement in the affinity of the antibody for antigen.

Amino acid substitutions may be introduced into the molecule of interest and the products screened for a desired activity, e.g., retained/improved antigen binding compared to parental murine molecule. Both conservative substitutions and non-conservative substitutions are contemplated.

Embodiments of the invention include amino acid sequence variants of the CD137 antigen binding molecules Amino acid sequence variants of the CD137 binding molecules are prepared by introducing appropriate modifications into the nucleotide sequence encoding the molecules, or by peptide synthesis.

Using the mouse sequence of selected antibody candidates, gene fragments were designed and synthesized for the murine VK and VH. Biotinylated forward primer containing specific sequence to the murine framework 1 region and an overhanging sequence annealed to the end of the Gene III sequence, and reverse primer from the conserved murine framework 4 region along with the human constant region (Cκ or CH1) are used to amplify the V region (See Table 8).

PCR was performed using the gene fragments as template and the DNA product was cloned into the M13LE01 vector (a modified version of M13 mp18 from New England Biolabs) using standard in house protocols and transformed into E. coli cells (FIG. 5). M13, provides the necessary components to package the DNA into phage particles which are secreted through the cell wall and released into the medium and extensive infection by phage can cause lysis in E. coli cells. Thus, infection with recombinant M13 phage can create plaques in E. coli cells when grown on L-agar plates. Individual plaques representing a particular change in DNA of interest were picked up and grown over night in E. coli, and corresponding cultures were mini-prepped to obtain the DNA sequence by sequencing analysis. Plaques carrying the correct DNA sequence of chimeric Fab were used to infect E. coli cells. After appropriate growth of cultures, E. coli cells were induced with 0.5 mM IPTG to express the chimeric Fab which is secreted into the culture medium. Expressed chimeric Fab was obtained from culture supernatants and/or periplasmic extracts of infected E. coli cells. This chimeric Fab was further used to develop ELISA binding assays and was kept as positive control to identify the humanized variants described later. Sequence of the chimeric Fab is described below.

TABLE 8

| | |
|---|---|
| Mu Vk DNA template | GACATCGTGATGACCCAGAGCCACAAGTTCATGAGCACCAGCGTGGGCGACCGCGTGAGCATCACC TGCAAGGCCAGCCAGGACGTGAGCACCGCCGTGGCCTGGTACCAGCAGAAGCCAGGCCAGAGCCCA AAGCTGCTGATCTACAGCGCCAGCTACCGCTACACCGGCGTGCCAGACCGCTTCACCGGCAGCGGC AGCGGCACCGACTTCACCTTCACCATCAGCAGCGTGCAGGCCGAGGACCTGGCCGTGTACTACTGC CAGCAGCACTACAGCAACCCATGGACCTTCGGCGGCGGCACCAAGCTGGAGATCAAG (SEQ ID NO.: 465) |

TABLE 8-continued

```
Mu VH DNA    GAGGTGAAGCTGGTGGAGAGCGAGGGCGGCCTGGTGCAGCCAGGCAGCAGCATGAAGCTGAGCTGC
template     ACCGCCAGCGGCTTCACCTTCAGCGACTTCTACATGGCCTGGGTGCGCCAGGTGCCAGAGAAGGGC
sequence     CTGGAGTGGGTGGCCAACATCAACTACGACGGCAGCAGCACCTACTACCTGGACAGCCTGAAGAGC
             CGCTTCATCATCAGCCGCGACAACGCCCGCAACATCCTGTACCTGCAGATGAGCAGCCTGAAGAGC
             GAGGACACCGCCACCTACTACTGCGCCCGCGAGGGCGACGAGGGCTGGTACTTCGACGTGTGGGGC
             GCCGGCACCACCGTGACCGTGAGCAGC (SEQ ID NO.: 466)

Cloning      muForward bio-hu VH FW1/GENE III       Reverse hu CH1
VH into      GGTGCCGTTCTATAGCCATAGCGAGGTGAAGCTG     GGAAGACCGATGGGCCCTTGGTGGAGGCGCT
M13LE01      GTGGAGAGCGAGGGCG (SEQ ID NO.: 467)     GCTCACGGTCACGGTGGTGC (SEQ ID
vector                                              NO.: 468)

Cloning      Forward VL                             Reverse CL
mu           GGTCGTTCCATTTTACTCCCACTCCGACATCGTG     CAGATGGTGCAGCCACAGTTCGCTTGATCTC
VL into      ATGACCCAGAGCCAC (SEQ ID NO.: 469)      CAGCTTGGTGCCGCCGCCGAAG
M13LE01                                             (SEQ ID NO.: 470)
vector
```

Sequence optimized Fabs were evaluated in ELISA binding assays as described below.

h. Identification of CD137 #1 Optimized Binders:

To identify humanized/optimized anti-CD137 binders, a 2D-sandwich ELISA assay was developed using chimeric anti-CD137 Fabs and throughout the experiment processes chimeric anti-CD137 Fab was kept as positive control identify the humanized variants which had similar binding to murine variable regions present in chimeric Fab. To develop the assays, plates were coated with Anti-Fd antibody which bind to the CH1 region in chimeric CD137 Fab fragment present in culture supernatants and/or periplasmic preps (E. coli cells are infected with phage containing chimeric CD137 Fab and induced with 0.5 mM IPTG and after 4 hours of incubation, supernatants are used or cells are lysed to obtain periplasmic extracts).

Bound CD137 Fab fragments are incubated in the presence of biotinylated huCD137 antigen, and the bound biotinylated antigen is detected with strep-avidin labeled flurochrome. Different amounts of the antigen (biotinylated huCD137-6xHis was generated using Sulfo ChromaLink™ Biotin kit (SoluLink, Catalog #B-1007; PPB-16748) (50 ng/mL and 80 ng/mL), and different dilutions of the chimeric Fab (Chi Fab)(0.4 µg/ml, 0.2 µg/ml and 0.1 µg/ml) were evaluated in a 2D assay. Plates were coated with different amounts of anti-Fd. (Meridian Life Sciences Inc., Sheep anti-human anti-Fd #W90075C); 1700 ng/mL anti-Fd antibody for the primary screening (secreted Fab) and with 900 ng/mL anti-Fd antibody for the confirmatory screening (periplasmic Fab) (See FIG. 4A).

i. Generation of Engrafted Fab Using CDRs from CD137 #1

The purpose of lead optimization/humanization is to obtain molecules with optimal amino acid sequences in the variable domain, both CDRs and framework, by converting as many non-human residues to the human germline sequence in order to reduce the probability of ADAs, which can impact drug efficacy and safety, removing likely PTM liabilities to improve product consistency and shelf life, and enhancing other CMC properties. Thus, a "humanized" antibody refers to an antibody comprising amino acid residues from non-human hypervariable region and amino acid residues from human FRs. In certain embodiments, a humanized antibody will comprise substantially all of at least one, and typically two, variable domains, in which all or substantially all of the hypervariable (e.g., CDRs) correspond to those of a non-human antibody, and all or substantially all of the FRs correspond to those of a human antibody.

To generate a humanized antibody which not only retains the binding and other desired properties of parental mouse molecule but also have characteristics of a potential drug, we evaluated closely matching germlines for both light and heavy chains by In silico analysis and identified IGKV1-39*01 and IGHV3-7*01 for light chain and heavy chains respectively. The CDRs of the mouse CD137 #B21 were combined with the frameworks of the human germlines: IGKV1-39*01 for VK and IGHV3-7*01 for VH. KJ2 was used as the J region in VK; HJ6 was used as the J region in VH.

The CDRs from CD137 specific clones are engrafted onto the VK germline and VH germline DNA fragments are amplified by PCR using known techniques. An example, below used the following primers in Table 9:

TABLE 9

```
hu Vk DNA    GACATCCAGATGACCCAGAGCCCAAGCAGCCTGAGCGCCAGCGTGGGCGACCGCGTGACCATCA
template     CCTGCAAGGCCAGCCAGGACGTGAGCACCGCCGTGGCCTGGTACCAGCAGAAGCCAGGCAAGGC
             CCCAAAGCTGCTGATCTACAGCGCCAGCTACCGCTACACCGGCGTGCCAAGCCGCTTCAGCGGC
             AGCGGCAGCGGCACCGACTTCACCCTGACCATCAGCAGCCTGCAGCCAGAGGACTTCGCCACCT
             ACTACTGCCAGCAGCACTACAGCAACCCATGGACCTTCGGCCAGGGCACCAAGCTGGAGATCAA
             G (SEQ ID NO.: 471)

hu VH DNA    GAGGTGCAGCTGGTGGAGAGCGGCGGCGGCCTGGTGCAGCCAGGCGGCAGCCTGCGCCTGAGCT
template     GCGCCGCCAGCGGCTTCACCTTCAGCGACTTCTACATGGCCTGGGTGCGCCAGGCCCCAGGCAA
sequence     GGGCCTGGAGTGGGTGGCCAACATCAACTACGACGGCAGCAGCACCTACTACCTGGACAGCCTG
             AAGAGCCGCTTCACCATCAGCCGCGACAACGCCAAGAACAGCCTGTACCTGCAGATGAACAGCC
             TGCGCGCCGAGGACACCGCCGTGTACTACTGCGCCCGCGAGGGCGACGAGGGCTGGTACTTCGA
             CGTGTGGGGCCAGGGCACCACCGTGACCGTGAGCAGC (SEQ ID NO.: 472)
```

TABLE 9-continued

```
Cloning      Forward bio-hu IGHV3-7*01       Reverse hu CHI
hu VH        GCCGTTCTATAGCCATAGCGAGGTGCAGCTG GTGTGGGGACAGGGCACAACTGTGACAGTGA
IGHV3-7*01   GTGGAGAGCGGAG (SEQ ID NO.: 473) GCTCCGCCTCCACCAAGGGCCCATCG
                                             (SEQ ID NO.: 474)

Cloning      Forward hu IGKV1-39*01          Reverse CL
hu VL        GTTCCATTTTACTCCCACTCCGACATCCAGA CAACCCCTGGACCTTTGGGCAGGGAACTAAG
IGKV1-39*01  TGACACAGAGCCCCAGCAGCCTGAGCGC    CTGGAGATCAAGCGAACTGTGGCTGCACCAT
             (SEQ ID NO.: 475)               C( SEQ ID NO.: 476)
```

A biotinylated forward primer containing specific sequence to the CD137 VH or VL gene segment and an overhanging sequence annealed to the end of the Gene III sequence and reverse primer from the conserved constant region (Cκ or CH1). The PCR products are cloned into M13LE01 vector to generate an engrafted Fab containing the same CDRs as the murine Fab, but in the human framework. The engrafted Fab was compared to the parental chimeric Fab in a binding titration to determine the binding to huCD137 antigen (FIG. 4B). For each candidate, specific binding to huCD137 was consistent over the assayed antigen concentration range for both the chimeric and engrafted Fab molecules. The engrafted Fab molecules were slightly lower in their bindings as observed in FIG. 4B however they were used as the basis for further optimization as they represented mouse CDRs on human frameworks. Besides the CDRs, certain mouse framework residues such as canonical and Vernier zone residues have been known to play an important role in positioning the CDR loops.

j. Optimization of Framework Regions in Human VK and VH

To identify the critical mouse such as canonical, interphase and Vernier zone residues that are known to play an important role in binding to antigen, we identified three framework positions in light chain variable region and 5 framework positions in heavy chain variable region. These positions were $T^{20}S$, $S^{60}D$, $T^{85}V$ in the light chain and the 5 positions in heavy chain corresponded to amino acids $A^{23}T$, $T^{69}I$, $N^{77}Q$, $S^{78}I$, $N^{84}S$ or Q. To identify the human framework that retained similar binding of murine lead candidate (CD137 #B21), we created a phage library in M13LE01 vector. Mutations/changes were made in the oligonucleotide sequences and they were assembled using standard molecular biology techniques.

A first phage library was constructed combining VK and VH framework mutations wherein the VK variant library represented eight possible variations and the VH variant library represented 128 possible variations; together the VK and VH variants libraries represented a total of ~1024 variants for the first combined library.

E. coli cells were transformed with the DNA containing different combinations and next day individual plaques representing a single variant were picked. Approximately 2700 clone variants were selected and screened for binding to huCD137 by ELISA as described earlier. Initially, E. coli cells were infected with each variant followed by induction with 0.5 mM IPTG and media supernatants were evaluated for bindings. In these experiments chimeric anti-CD137 Fab was kept as positive control in ELISA experiments. Molecules that depicted binding similar to positive control were selected were checked for their binding activity again. In the second step, plaques representing the selected binders were used to infect the E. coli cells again and cultures were induced with 0.5 mM IPTG. After necessary incubations, cells were lysed and periplasmic extracts were obtained. These periplasmic extracts were used to confirm the binding to CD137 antigen. As earlier, we kept chimeric Fab as positive control in our experiments.

Based on binding results as detected by ELISA, the best VK and VH framework sequence combinations were determined.

As can be seen in FIG. 5, clones B21-55 and B21-49 had as good or slightly improved binding characteristics as the chimeric parental Fab. Sequence analysis of these light chain frameworks revealed amino acid mutation $T^{85}V$ in FW3 was present in both clones, and thus was considered an important improvement to binding and thus to be included in optimized molecules. For the VH, amino acid mutation $S^{78}I$ in FW3 was also present in both clones and thus was considered important for optimized molecules.

TABLE 10

| Fab CLONE | VH SEQUENCE (underlined mutations) | VK SEQUENCE |
|---|---|---|
| B21. parent | EVKLVESEGGGLVQPGSSMKLSCTASGFTFSDFYMAWVRQ VPEKGLEWVANINYDGSSTYYLDSLKSRFIISRDNARN<u>I</u> LYLQMSSLKSEDTATYYCAREGDEGWYFDVWGAGTTVTV SS (SEQ ID NO.: 455) | DIVMTQSHKFMSTSVGDRVSITCKASQDVSTAVAWYQQ KPGQSPKLLIYSASYRYTGVPDRFTGSGSGTDFTFTIS SVQAEDLA<u>V</u>YYCQQHYSNPWTFGGGTKLEIK (SEQ ID NO.: 456) |
| B21-55 | EVQLVESGGGLVQPGGSLRLSCAASGFTFSDFYMAWVRQ APGKGLEWVANINYDGSSTYYLDSLKSRFTISRDNAKN<u>I</u> LYLQM<u>N</u>SLRAEDTAVYYCAREGDEGWYFDVWGQGTTVTV SS (SEQ ID NO.: 477) | DIQMTQSPSSLSASVGDRVTITCKASQDVSTAVAWYQQ KPGKAPKLLIYSASYRYTGVPSRFSGSGSGTDFTLTIS SLQPEDFA<u>V</u>YYCQQHYSNPWTFGQGTKLEIK (SEQ ID NO.: 478) |
| B21-49 | EVQLVESGGGLVQPGGSLRLSCAASGFTFSDFYMAWVRQ APGKGLEWVANINYDGSSTYYLDSLKSKFTISRDNAKN<u>I</u> LYLQMQSLRAEDTAVYYCAREGDEGWYFDVWGQGTTVTV SS (SEQ ID NO.: 479) | DIQMTQSPSSLSASVGDRVTITCKASQDVSTAVAWYQQ KPGKAPKWYSASYRYTGVPDRFSGSGSGTDFTLTISSL QPEDFA<u>V</u>YYCQQHYSNPWTFGQGTKLEIK (SEQ ID NO.: 480) |

TABLE 10-continued

| Fab CLONE | VH SEQUENCE (underlined mutations) | VK SEQUENCE |
|---|---|---|
| B21-51 | EVQLVESGGGLVQPGGSLRLSCAASGFTFSDFYMAWVRQ APGKGLEWVANINYDGSSTYYLDSLKSRFIISRDNAK<u>N</u><u>I</u> LYLQMSSLRAEDTAVYYCAREGDEGWYFDVWGQGTTVT<u>V</u> SS (SEQ ID NO.: 481) | DIQMTQSPSSLSASVGDRVTITCKASQDVSTAVAWYQQ KPGKAPKWYSASYRYTGVPDRFSGSGSGTDFTLTISSL QPEDFA<u>V</u>YYCQQHYSNPWTFGQGTKLEIK (SEQ I<u>D</u> NO.: 482) |
| B21-69 | EVQLVESGGGLVQPGGSLRLSCTASGFTFSDFYMAWVRQ APGKGLEWVANINYDGSSTYYLDSLKSRFTISRDNAK<u>N</u><u>I</u> LYLQMNSLRAEDTAVYYCAREGDEGWYFDVWGQGTTVT<u>V</u> SS (SEQ ID NO.: 483) | DIQMTQSPSSLSASVGDRVSITCKASQDVSTAVAWYQQ KPGKAPKWYSASYRYTGVPSRFSGSGSGTDFTLTISSL QPEDFA<u>V</u>YYCQQHYSNPWTFGQGTKLEIK (SEQ I<u>D</u> NO.: 484) |
| B21-68 | EVQLVESGGGLVQPGGSLRLSCAASGFTFSDFYMAWVRQ APGKGLEWVANINYDGSSTYYLDSLKSRFTISRDNAKNI LYLQMQSLRAEDTAVYYCAREGDEGWYFDVWGQGTTVTV SS (SEQ ID NO.: 485) | DIQMTQSPSSLSASVGDRVTITCKASQDVSTAVAWYQQ KPGKAPKLLIYSASYRYTGVPSRFSGSGSGTDFTLTIS SLQPEDFATYYCQQHYSNPWTFGQGTKLEIK (SEQ ID NO.: 486) |
| B21-46 | EVQLVESGGGLVQPGGSLRLSCAASGFTFSDFYMAWVRQ APGKGLEWVANINYDGSSTYYLDSLKSRFTISRDNAKNS LYLQMNSLRAEDTAVYYCAREGDEGWYFDVWGQGTTVTV SS (SEQ ID NO.: 487) | DIQMTQSPSSLSASVGDRVSITCKASQDVSTAVAWYQQ KPGKAPKLLIYSASYRYTGVPDRFSGSGSGTDFTLTIS SLQPEDFAVYYCQQHYSNPWTFGQGTKLEIK (SEQ ID NO.: 488) |
| B21-47 | EVQLVESGGGLVQPGGSLRLSCAASGFTFSDFYMAWVRQ APGKGLEWVANINYDGSSTYYLDSLKSRFIISRDNAKNI LYLQMNSLRAEDTAVYYCAREGDEGWYFDVWGQGTTVTV SS (SEQ ID NO.: 489) | DIQMTQSPSSLSASVGDRVTITCKASQDVSTAVAWYQQ KPGKAPKLLIYSASYRYTGVPDRFSGSGSGTDFTLTIS SLQPEDFATYYCQQHYSNPWTFGQGTKLEIK (SEQ ID NO.: 490) |
| B21-61 | EVQLVESGGGLVQPGGSLRLSCAASGFTFSDFYMAWVRQ APGKGLEWVANINYDGSSTYYLDSLKSRFTISRDNAKNS LYLQMQSLRAEDTAVYYCAREGDEGWYFDVWGQGTTVTV SS (SEQ ID NO.: 491) | DIQMTQSPSSLSASVGDRVSITCKASQDVSTAVAWYQQ KPGKAPKLLIYSASYRYTGVPDRFSGSGSGTDFTLTIS SLQPEDFATYYCQQHYSNPWTFGQGTKLEIK (SEQ ID NO.: 492) |
| B21-72 | EVQLVESGGGLVQPGGSLRLSCAASGFTFSDFYMAWVRQ APGKGLEWVANINYDGSSTYYLDSLKSRFTISRDNAKNI LYLQMSSLRAEDTAVYYCAREGDEGWYFDVWGQGTTVTV SS (SEQ ID NO.: 493) | DIQMTQSPSSLSASVGDRVSITCKASQDVSTAVAWYQQ KPGKAPKLLIYSASYRYTGVPDRFSGSGSGTDFTLTIS SLQPEDFATYYCQQHYSNPWTFGQGTKLEIK (SEQ ID NO.: 494) |
| B21-48 | EVQLVESGGGLVQPGGSLRLSCAASGFTFSDFYMAWVRQ APGKGLEWVANINYDGSSTYYLDSLKSRFIISRDNAKNI LYLQMQSLRAEDTAVYYCAREGDEGWYFDVWGQGTTVTV SS (SEQ ID NO.: 495) | DIQMTQSPSSLSASVGDRVSITCKASQDVSTAVAWYQQ KPGKAPKLLIYSASYRYTGVPSRFSGSGSGTDFTLTIS SLQPEDFAVYYCQQHYSNPWTFGQGTKLEIK (SEQ ID NO.: 496) |

Provided are the sequences for some of the top binders from the first library.

k. Mutational Analysis of CDRs L-CDR1, L-CDR2, H-CDR1 and H-CDR2 in Chimeric VK and Chimeric VH Certain amino acid residues such as asparagine and aspartic acid in CDRs can result in heterogeneity in drug candidates by undergoing post-translation modification such as deamidation, glycosylation and iso-aspartate isomerization which can reduce the shelf life of drug candidate. In addition, to reduce the generation of anti-drug antibodies, germlining has evolved as a novel strategy to change non-critical mouse residues with human germline residues. We evaluated the CDR residues for potential liabilities and evaluated their changing the residues without impacting the necessary binding/function.

Mutational analysis was performed to evaluate the effect of point mutations in CDRs in the light chain, in L-CDR1, L-CDR2, and the heavy chain H-CDR1 and H-CDR2 and the resulting variant was evaluated as compared to the parental chimeric IgG which has mouse variable region but human constant regions. Ten point mutations were introduced into the light chain (VL) CDR1 and CDR2 and 19 point mutants were introduced into the heavy chain (VH) CDR1 and CDR2 (FIGS. 6A and 6B) utilizing standard molecular biology techniques one by one separately.

The VL and VH genes were generated using the method as discussed above, and cloned into pTT5 vector. The sequence of each VL and VH was confirmed by standard methods.

Single point mutants were made replacing chimeric "parental" residues (1Chi Ig VK) with "variant" resides ("bold" box). FIG. 22 and FIG. 23 represent the single point mutants for VK CDRs at amino acid positions 24, 23, 29, 31 and 33 in CDR1, and 50, 53, 54, 55, and 56 in CDR2, yielding 10 variant constructs. FIG. 24 and FIG. 25 represents the single point mutants for VH CDRs at amino acid positions 31, 32, 33, and 35 in CDR1, and 52, 53, 54, 55, 57, 58, 61, 62, 63, 64, and 66 in CDR2 yielding 19 variant constructs.

The resulting light chain mutants were paired with the parental chimeric heavy chain and heavy chain mutants were paired with parental chimeric light chain for expression analysis in CHO-E cells for 7 days. The parental chimeric IgG was used as positive control.

After 7 days, the antibody containing supernatants were collected and evaluated for binding to biotinylated huCD137 in ELISA. Effects on CD137 specific binding was evaluated based on the mutations introduced into the VH and VL regions for each of the variants. CD137 binding was measured and expressed as OD units and which was compared with the parental chimeric IgG to identify the contribution of individual residues in CD137 antibody binding (FIGS. 6A and 6B).

For the light chain variants, point mutants at all positions depicted demonstrated binding similar to the parental chimeric IgG (FIG. 6A). For the heavy chain, point mutants at positions $A^{35}S$, $T^{58}K$, $L^{61}V$, $L^{64}V$ and $S^{66}G$ depicted binding similar binding to the parental chimeric IgG (FIG. 6B).

l. Mutational Library for Human CD137 VK and VH in B21-55

From Table 10 and FIG. 5, B21-55 was identified as the best-humanized framework sequence for both light chain and heavy chain variable region that retained binding as B21 parental chimeric Fab and further CDR changes were incorporated in this framework. Three phage Fab libraries were prepared in vector LE01. The first (phage Fab) library, L458VK, was a combination of chimeric human/murine VK light chains including variants with multiple FW and CDR point mutations representing ~1024 variants, which were combined with an engrafted/humanized VH library including variants with multiple FW and CDR point mutations. A second phage Fab library, L459VH, was a combination of engrafted human VH including CDR point mutations combined with the engrafted human VK, representing ~512 VH variants. The third phage Fab library, L460C, was a combination of human VK and human VH FW mutations. For these libraries, the VK had ~1024 possible variations and the VH had ~512 possible variations; making a total of ~524, 288 variants for the combined library, L460C. We evaluated ~1980 variants.

TABLE 15

| Vk | VH |
|---|---|
| K24R (CDR1) | A35S (CDR1) |
| D28S (CDR1) | N52Q |
| V29I (CDR1) | D54E |
| T31S (CDR1) | G55A |
| V33L (CDR1) | T58K |
| S50A (CDR2) | L61V (CDR 2) |

TABLE 15-continued

| Vk | VH |
|---|---|
| Y53S (CDR2) | D62E (CDR 2) |
| R54L (CDR2) | L64V (CDR2) |
| Y55Q (CDR2) | S66G (CDR2) |
| T56S (CDR2) | |

Isolated Vlc variant clones CD137 #1.V55A-J, having mutations at positions $K^{24}R$, $D^{28}S$, $V^{29}I$, $T^{31}S$, $V^{33}L$, $S^{50}A$, $Y^{53}S$, $R^{54}L$, $Y^{55}Q$ and $T^{56}S$ were selected to be evaluated phage Fab in vector LE01.

Isolated VH variant clones CD137 #1 V.55.N, V55.T, V55.V, V55.W, V55.AA, V55.BB having mutations at positions $A^{35}S$, $N^{52}Q$, $D^{54}E$, $G^{55}A$, $T^{58}K$, $L^{61}V$, $D^{62}E$, $L^{64}V$ and $S^{66}G$ were selected to be evaluated in vector LE01. The changes $N^{52}Q$ H-CDR2 was selected to evaluate the removal of a potential deamidation site. The changes $D^{54}E$ and $D^{62}E$ in H-CDR2 were selected to evaluate the removal of a potential isomerization sites.

Figure 7:
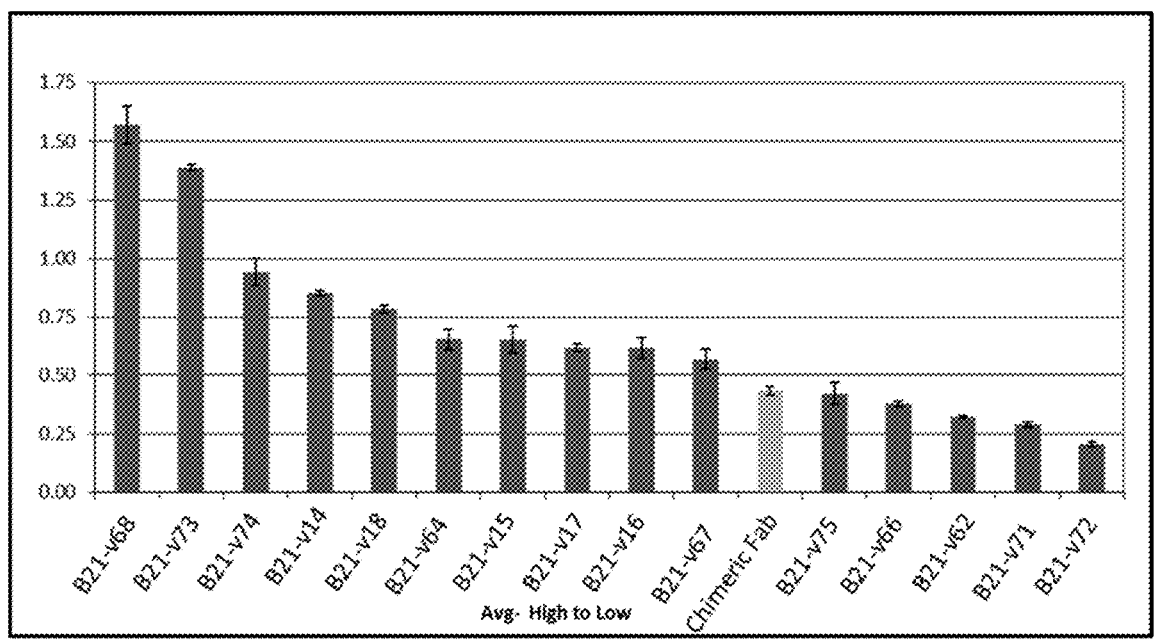
FIG. 7. ELISA results comparing binding of anti-CD137 Fabs incorporating combinations of the Vk and VH amino acid modifications. Fabs that were identified on the basis of binding primary ELISA assays were then evaluated for binding with respect to chimeric B21-chimeric Parent Fab. Binding analysis of Fabs to human CD137 is shown for 15 positive binders from the VK/VH combination library, including V68, V73, V74, V14, V18, V64, V15, V17, V16, V67, V75, V66, V62, V71, and V72 arranged in comparison to the parent B21 chimeric Fab parent.

Variants were compared with the chimeric CD137 parent, and analysis of 75 variants was performed. Of the 75 variants, 55 variant clones had similar or better binding to the chimera molecule (FIG. 7).

m. Selected CD137 Sequence Optimized Candidates were Formatted as IgG1-KO and Evaluated for Functional Activity Thirty-nine of the hits were selected from the CD137 #B21 sequence optimization campaign and were formatted as IgG1-KO and were evaluated for agonist behaviour without and with cross linking by a secondary antibody as described above in the NFkB-Jurakat cell assay system (Promega) as shown in FIGS. 8A and 8B.

TABLE 16

CD137 B21 Variants

| | CD137 Clone | VH | VK |
|---|---|---|---|
| P | Parent | EVKLVESEGGGLVQPGSSMKLSCTASGFTFSDFYMAWVR QVPEKGLEWVANINYDGSSTYYLDSLKSRFIISRDNAR NILYLQMSSLKSEDTATYYCAREGDEGWYFDVWGAGTT VTVSS (SEQ ID NO.: 455) | DIVMTQSHKFMSTSVGDRVSITCKASQDVSTAVAWYQQ KPGQSPKLLIYSASYRYTGVPDRFTGSGSGTDFTFTIS SVQAEDLAVYYCQQHYSNPWTFGGGTKLEIK (SEQ ID NO.: 456) |
| 1 | B21v1 | EVQLVESGGGLVQPGGSLRLSCAASGFTFSDFYMSWVR QAPGKGLEWVANINYDASSKYYVESLKSRFTISRDNAK NILYLQMNSLRAEDTAVYYCAREGDEGWYFDVWGQGTT VTVSS (SEQ ID NO.: 525) | DIQMTQSPSSLSASVGDRVTITCKASQDISSAVAWYQQ KPGKAPKWYSASYLYTGVPSRFSGSGSGTDFTLTISSL QPEDFAVYYCQQHYSNPWTFGQGTKLEIK (SEQ ID NO.: 526) |
| 2 | B21v2 | EVQLVESGGGLVQPGGSLRLSCAASGFTFSDFYMSWVR QAPGKGLEWVANINYQYEGSSKYYVESLKGRFTISRDNAK NILYLQMNSLRAEDTAVYYCAREGDEGWYFDVWGQGTT VTVSS (SEQ ID NO.: 527) | DIQMTQSPSSLSASVGDRVTITCRASQDVSTAVAWYQQ KPGKAPKLLIYAASYLYSGVPSRFSGSGSGTDFTLTIS SLQPEDFAVYYCQQHYSNPWTFGQGTKLEIK (SEQ ID NO.: 528) |
| 3 | B21v3 | EVQLVESGGGLVQPGGSLRLSCAASGFTFSDFYMSWVR QAPGKGLEWVANINYDASSKYYLESVKSRFTISRDNAK NILYLQMNSLRAEDTAVYYCAREGDEGWYFDVWGQGTT VTVSS (SEQ ID NO.: 529) | DIQMTQSPSSLSASVGDRVTITCRASQDISTAVAWYQQ KPGKAPKLLIYAASYLQSGVPSRFSGSGSGTDFTLTIS SLQPEDFAVYYCQQHYSNPWTFGQGTKLEIK (SEQ ID NO.: 530) |
| 4 | B21v4 | EVQLVESGGGLVQPGGSLRLSCAASGFTFSDFYMSWVR QAPGKGLEWVANINYEGSSKYYLDSLKSRFTISRDNAK NILYLQMNSLRAEDTAVYYCAREGDEGWYFDVWGQGTT VTVSS (SEQ ID NO.: 531) | DIQMTQSPSSLSASVGDRVTITCKASQDVSSAVAWYQQ KPGKAPKLLIYAASYRQSGVPSRFSGSGSGTDFTLTIS SLQPEDFAVYYCQQHYSNPWTFGQGTKLEIK (SEQ ID NO.: 532) |
| 5 | B21v5 | EVQLVESGGGLVQPGGSLRLSCAASGFTFSDFYMSWVR QAPGKGLEWVANINYDASSKYYVESLKSRFTISRDNAK NILYLQMNSLRAEDTAVYYCAREGDEGWYFDVWGQGTT VTVSS (SEQ ID NO.: 533) | DIQMTQSPSSLSASVGDRVTITCRASQDISTAVAWYQQ KPGKAPKLLIYAASSRQTGVPSRFSGSGSGTDFTLTIS SLQPEDFAVYYCQQHYSNPWTFGQGTKLEIK (SEQ ID NO.: 534) |
| 6 | B21v6 | EVQLVESGGGLVQPGGSLRLSCAASGFTFSDFYMSWVR QAPGKGLEWVANINYDASSKYYVESLKGRFTISRDNAK NILYLQMNSLRAEDTAVYYCAREGDEGWYFDVWGQGTT VTVSS (SEQ ID NO.: 535) | DIQMTQSPSSLSASVGDRVTITCKASQSVSTALAWYQQ KPGKAPKWYSASYRYTGVPSKFSGSGSGTDFTLTIISL QPEDFAVYYCQQHYSNPWTFGQGTKLEIK (SEQ ID NO.: 536) |

TABLE 16-continued

CD137 B21 Variants

| CD137 Clone | VH | VK |
|---|---|---|
| 7 B21v7 | EVQLVESGGGLVQPGGSLRLSCAASGFTFSDFYMSWVR QAPGKGLEWVANINYEGSSKYYLESVKGRFTISRDNAK NILYLQMNSLRAEDTAVYYCAREGDEGWYFDVWGQGTT VTVSS (SEQ ID NO.: 537) | DIQMTQSPSSLSASVGDRVTITCKASQDVSTALAWYQQ KPGKAPKLLIYSASSRQSGVPSRFSGSGSGTDFTLTIS SLQPEDFAVYYCQQHYSNPWTFGQGTKLEIK (SEQ ID NO.: 538) |
| 8 B21v8 | EVQLVESGGGLVQPGGSLRLSCAASGFTFSDFYMSWVR QAPGKGLEWVANINYDASSTYYVDSLKGRFTISRDNAK NILYLQMNSLRAEDTAVYYCAREGDEGWYFDVWGQGTT VTVSS (SEQ ID NO.: 539) | DIQMTQSPSSLSASVGDRVTITCKASQDISTAVAWYQQ KPGKAPKLLIYAASYLQTGVPSRFSGSGSGTDFTLTIS SLQPEDFAVYYCQQHYSNPWTFGQGTKLEIK (SEQ ID NO.: 540) |
| 9 B21v9 | EVQLVESGGGLVQPGGSLRLSCAASGFTFSDFYMSWVR QAPGKGLEWVANINYEGSSKYYVESVKGRFTISRDNAK NILYLQMNSLRAEDTAVYYCAREGDEGWYFDVWGQGTT VTVSS (SEQ ID NO.: 541) | DIQMTQSPSSLSASVGDRVTITCRASQDVSSALAWYQQ KPGKAPKLLIYAASYLYTGVPSRFSGSGSGTDFTLTIS SLQPEDFAVYYCQQHYSNPWTFGQGTKLEIK (SEQ ID NO.: 542) |
| 10 B21v10 | EVQLVESGGGLVQPGGSLRLSCAASGFTFSDFYMAWVR QAPGKGLEWVANINYEGSSKYYVDSLKGRFTISRDNAK NILYLQMNSLRAEDTAVYYCAREGDEGWYFDVWGQGTT VTVSS (SEQ ID NO.: 543) | DIQMTQSPSSLSASVGDRVTITCRASQDVSTAVAWYQQ KPGKAPKLLIYSASSRQSGVPSRFSGSGSGTDFTLTIS SLQPEDFAVYYCQQHYSNPWTFGQGTKLEIK (SEQ ID NO.: 544) |
| 11 B21v11 | EVQLVESGGGLVQPGGSLRLSCAASGFTFSDFYMSWVR QAPGKGLEWVANINYDASSTYYVDSLKSRFTISRDNAK NILYLQMNSLRAEDTAVYYCAREGDEGWYFDVWGQGTT VTVSS (SEQ ID NO.: 545) | DIQMTQSPSSLSASVGDRVTITCRASQDVSSALAWYQQ KPGKAPKLLIYSASYRYSGVPSRFSGSGSGTDFTLTIS SLQPEDFAVYYCQQHYSNPWTFGQGTKLEIK (SEQ ID NO.: 546) |
| 12 B21v12 | EVQLVESGGGLVQPGGSLRLSCAASGFTFSDFYMSWVR QAPGKGLEWVANINYEGSSKYYLDSLKSRFTISRDNAK NILYLQMNSLRAEDTAVYYCAREGDEGWYFDVWGQGTT VTVSS (SEQ ID NO.: 547) | DIQMTQSPSSLSASVGDRVTITCRASQSVSTAVAWYQQ KPGKAPKLLIYSASSLQTGVPSRFSGSGSGTDFTLTIS SLQPEDFAVYYCQQHYSNPWTFGQGTKLEIK (SEQ ID NO.: 548) |
| 13 B21v13 | EVQLVESGGGLVQPGGSLRLSCAASGFTFSDFYMSWVR QAPGKGLEWVANINYEGSSTYYLDSLKSRFTISRDNAK NILYLQMNSLRAEDTAVYYCAREGDEGWYFDVWGQGTT VTVSS (SEQ ID NO.: 549) | DIQMTQSPSSLSASVGDRVTITCKASQDISTALAWYQQ KPGKAPKLLIYSASYLYTGVPSRFSGSGSGTDFTLTIS SLQPEDFAVYYCQQHYSNPWTFGQGTKLEIK (SEQ ID NO.: 550) |
| 14 B21v14 | EVQLVESGGGLVQPGGSLRLSCAASGFTFSDFYMSWVR QAPGKGLEWVANINYDASSTYYVDSLKSRFTISRDNAK NILYLQMNSLRAEDTAVYYCAREGDEGWYFDVWGQGTT VTVSS (SEQ ID NO.: 551) | DIQMTQSPSSLSASVGDRVTITCKASQDVSSAVAWYQQ KPGKAPKWYSASYLQSGVPSRFSGSGSGTDFTLTISSL QPEDFAVYYCQQHYSNPWTFGQGTKLEIK (SEQ ID NO.: 552) |
| 15 B21v15 | EVQLVESGGGLVQPGGSLRLSCAASGFTFSDFYMSWVR QAPGKGLEWVANINYDASSTYYLDSLKGRFTISRDNAK NILYLQMNSLRAEDTAVYYCAREGDEGWYFDVWGQGTT VTVSS (SEQ ID NO.: 553) | DIQMTQSPSSLSASVGDRVTITCKASQDISTALAWYQQ KPGKAPKLLIYAASYLQSGVPSRFSGSGSGTDFTLTIS SLQPEDFAVYYCQQHYSNPWTFGQGTKLEIK (SEQ ID NO.: 554) |
| 16 B21v16 | EVQLVESGGGLVQPGGSLRLSCAASGFTFSDFYMSWVR QAPGKGLEWVANINYEGSSKYYVESVKGRFTISRDNAK NILYLQMNSLRAEDTAVYYCAREGDEGWYFDVWGQGTT VTVSS (SEQ ID NO.: 555) | DIQMTQSPSSLSASVGDRVTITCKASQDISSAVAWYQQ KPGKAPKWYSASSRYTGVPSRFSGSGSGTDFTLTISSL QPEDFAVYYCQQHYSNPWTFGQGTKLEIK (SEQ ID NO.: 556) |
| 17 B21v17 | EVQLVESGGGLVQPGGSLRLSCAASGFTFSDFYMSWVR QAPGKGLEWVANINYEGSSTYYVDSVKGRFTISRDNAK NILYLQMNSLRAEDTAVYYCAREGDEGWYFDVWGQGTT VTVSS (SEQ ID NO.: 557) | DIQMTQSPSSLSASVGDRVTITCRASQDISTAVAWYQQ KPGKAPKWYSASYRYTGVPSRFSGSGSGTDFTLTISSL QPEDFAVYYCQQHYSNPWTFGQGTKLEIK (SEQ ID NO.: 558) |
| 18 B21v18 | EVQLVESGGGLVQPGGSLRLSCAASGFTFSDFYMSWVR QAPGKGLEWVANINYEGSSKYYVDSLKGRFTISRDNAK NILYLQMNSLRAEDTAVYYCAREGDEGWYFDVWGQGTT VTVSS (SEQ ID NO.: 559) | DIQMTQSPSSLSASVGDRVTITCRASQSVSTALAWYQQ KPGKAPKLLIYAASSRYSGVPSRFSGSGSGTDFTLTIS SLQPEDFAVYYCQQHYSNPWTFGQGTKLEIK (SEQ ID NO.: 560) |
| 19 B21v19 | EVQLVESGGGLVQPGGSLRLSCAASGFTFSDFYMSWVR QAPGKGLEWVANINYEGSSKYYLESVKGRFTISRDNAK NILYLQMNSLRAEDTAVYYCAREGDEGWYFDVWGQGTT VTVSS (SEQ ID NO.: 561) | DIQMTQSPSSLSASVGDRVTITCRASQDISTAVAWYQQ KPGKAPKWYSASYLYSGVPSRFSGSGSGTDFTLTISSL QPEDFAVYYCQQHYSNPWTFGQGTKLEIK (SEQ ID NO.: 562) |
| 20 B21v20 | EVQLVESGGGLVQPGGSLRLSCAASGFTFSDFYMSWVR QAPGKGLEWVANINQYEGSSKYYLDSLKGRFTISRDNAK NILYLQMNSLRAEDTAVYYCAREGDEGWYFDVWGQGTT VTVSS (SEQ ID NO.: 563) | DIQMTQSPSSLSASVGDRVTITCRASQSVSSALAWYQQ KPGKAPKLLIYAASYRQSGVPSRFSGSGSGTDFTLTIS SLQPEDFAVYYCQQHYSNPWTFGQGTKLEIK (SEQ ID NO.: 564) |
| 21 B21v22 | EVQLVESGGGLVQPGGSLRLSCAASGFTFSDFYMSWVR QAPGKGLEWVANINYEASSKYYVDSLKGRFTISRDNAK NILYLQMNSLRAEDTAVYYCAREGDEGWYFDVWGQGTT VTVSS (SEQ ID NO.: 565) | DIQMTQSPSSLSASVGDRVTITCRASQSVSSALAWYQQ KPGKAPKLLIYAASYRQSGVPSRFSGSGSGTDFTLTIS SLQPEDFAVYYCQQHYSNPWTFGQGTKLEIK (SEQ ID NO.: 566) |

TABLE 16-continued

CD137 B21 Variants

| CD137 Clone | VH | VK |
|---|---|---|
| 22 B21v23 | EVQLVESGGGLVQPGGSLRLSCAASGFTFSDFYMSWVRQAPGKGLEWVANIQYEGSSKYYVESLKGRFTISRDNAKNILYLQMNSLRAEDTAVYYCAREGDEGWYFDVWGQGTTVTVSS (SEQ ID NO.: 567) | DIQMTQSPSSLSASVGDRVTITCRASQSVSSALAWYQQKPGKAPKLLIYAASYRQSGVPSRFSGSGSGTDFTLTISSLQPEDFAVYYCQQHYSNPWTFGQGTKLEIK (SEQ ID NO.: 568) |
| 23 B21v24 | EVQLVESGGGLVQPGGSLRLSCAASGFTFSDFYMSWVRQAPGKGLEWVANIQYEGSSKYYVESLKGRFTISRDNAKNILYLQMNSLRAEDTAVYYCAREGDEGWYFDVWGQGTTVTVSS (SEQ ID NO.: 569) | DIQMTQSPSSLSASVGDRVTITCRASQDISTALAWYQQKPGKAPKLLIYSASYRQTGVPSRFSGSGSGTDFTLTISSLQPEDFAVYYCQQHYSNPWTFGQGTKLEIK (SEQ ID NO.: 570) |
| 24 B21v25 | EVQLVESGGGLVQPGGSLRLSCAASGFTFSDFYMSWVRQAPGKGLEWVANIQYEGSSKYYVESLKGRFTISRDNAKNILYLQMNSLRAEDTAVYYCAREGDEGWYFDVWGQGTTVTVSS (SEQ ID NO.: 571) | DIQMTQSPSSLSASVGDRVTITCRASQSISTAVAWYQQKPGKAPKLLIYAASYLYSGVPSRFSGSGSGTDFTLTISSLQPEDFAVYYCQQHYSNPWTFGQGTKLEIK (SEQ ID NO.: 572) |
| 25 B21v26 | EVQLVESGGGLVQPGGSLRLSCAASGFTFSDFYMSWVRQAPGKGLEWVANIQYEGSSKYYVESLKGRFTISRDNAKNILYLQMNSLRAEDTAVYYCAREGDEGWYFDVWGQGTTVTVSS (SEQ ID NO.: 573) | DIQMTQSPSSLSASVGDRVTITCKASQSVSTAVAWYQQKPGKAPKLLIYAASSLQSGVPSRFSGSGSGTDFTLTISSLQPEDFAVYYCQQHYSNPWTFGQGTKLEIK (SEQ ID NO.: 574) |
| 26 B21v27 | EVQLVESGGGLVQPGGSLRLSCAASGFTFSDFYMSWVRQAPGKGLEWVANIQYEGSSKYYVESLKGRFTISRDNAKNILYLQMNSLRAEDTAVYYCAREGDEGWYFDVWGQGTTVTVSS (SEQ ID NO.: 575) | DIQMTQSPSSLSASVGDRVTITCRASQDISTAVAWYQQKPGKAPKLLIYSASSLQSGVPSRFSGSGSGTDFTLTISSLQPEDFAVYYCQQHYSNPWTFGQGTKLEIK (SEQ ID NO.: 576) |
| 27 B21v28 | EVQLVESGGGLVQPGGSLRLSCAASGFTFSDFYMSWVRQAPGKGLEWVANIQYEGSSKYYVESLKGRFTISRDNAKNILYLQMNSLRAEDTAVYYCAREGDEGWYFDVWGQGTTVTVSS (SEQ ID NO.: 577) | DIQMTQSPSSLSASVGDRVTITCKASQSISTAVAWYQQKPGKAPKLLIYAASSRQTGVPSRFSGSGSGTDFTLTISSLQPEDFAVYYCQQHYSNPWTFGQGTKLEIK (SEQ ID NO.: 578) |
| 28 B21v29 | EVQLVESGGGLVQPGGSLRLSCAASGFTFSDFYMSWVRQAPGKGLEWVANIQYEGSSKYYVESLKGRFTISRDNAKNILYLQMNSLRAEDTAVYYCAREGDEGWYFDVWGQGTTVTVSS (SEQ ID NO.: 579) | DIQMTQSPSSLSASVGDRVTITCKASQSISTALAWYQQKPGKAPKLLIYAASYRYSGVPSRFSGSGSGTDFTLTISSLQPEDFAVYYCQQHYSNPWTFGQGTKLEIK (SEQ ID NO.: 580) |
| 29 B21v30 | EVQLVESGGGLVQPGGSLRLSCAASGFTFSDFYMSWVRQAPGKGLEWVANIQYEGSSKYYVESLKGRFTISRDNAKNILYLQMNSLRAEDTAVYYCAREGDEGWYFDVWGQGTTVTVSS (SEQ ID NO.: 581) | DIQMTQSPSSLSASVGDRVTITCKASQDISTALAWYQQKPGKAPKLLIYAASYLYSGVPSRFSGSGSGTDFTLTISSLQPEDFAVYYCQQHYSNPWTFGQGTKLEIK (SEQ ID NO.: 582) |
| 30 B21v31 | EVQLVESGGGLVQPGGSLRLSCAASGFTFSDFYMSWVRQAPGKGLEWVANIQYEGSSKYYVESLKGRFTISRDNAKNILYLQMNSLRAEDTAVYYCAREGDEGWYFDVWGQGTTVTVSS (SEQ ID NO.: 583) | DIQMTQSPSSLSASVGDRVTITCRASQSISTALAWYQQKPGKAPKLLIYSASSLQTGVPSRFSGSGSGTDFTLTISSLQPEDFAVYYCQQHYSNPWTFGQGTKLEIK (S(SEQ ID NO.: 584) |
| 31 B21v32 | EVQLVESGGGLVQPGGSLRLSCAASGFTFSDFYMSWVRQAPGKGLEWVANIQYEGSSKYYVESLKGRFTISRDNAKNILYLQMNSLRAEDTAVYYCAREGDEGWYFDVWGQGTTVTVSS (S(SEQ ID NO.: 585) | DIQMTQSPSSLSASVGDRVTITCRASQDISTALAWYQQKPGKAPKLLIYSASYLQSGVPSRFSGSGSGTDFTLTISSLQPEDFAVYYCQQHYSNPWTFGQGTKLEIK (S(SEQ ID NO.: 586) |
| 32 B21v33 | EVQLVESGGGLVQPGGSLRLSCAASGFTFSDFYMSWVRQAPGKGLEWVANIQYEGSSKYYVESLKGRFTISRDNAKNILYLQMNSLRAEDTAVYYCAREGDEGWYFDVWGQGTTVTVSS (S(SEQ ID NO.: 587) | DIQMTQSPSSLSASVGDRVTITCKASQSISTALAWYQQKPGKAPKLLIYSASYLQSGVPSRFSGSGSGTDFTLTISSLQPEDFAVYYCQQHYSNPWTFGQGTKLEIK (SEQ ID NO.: 588) |
| 33 B21v34 | EVQLVESGGGLVQPGGSLRLSCAASGFTFSDFYMSWVRQAPGKGLEWVANIQYEGSSKYYVESLKGRFTISRDNAKNILYLQMNSLRAEDTAVYYCAREGDEGWYFDVWGQGTTVTVSS (S(SEQ ID NO.: 589) | DIQMTQSPSSLSASVGDRVTITCRASQDISTAVAWYQQKPGKAPKLLIYAASYLQSGVPSRFSGSGSGTDFTLTISSLQPEDFAVYYCQQHYSNPWTFGQGTKLEIK (S(SEQ ID NO.: 590) |
| 34 B21v35 | EVQLVESGGGLVQPGGSLRLSCAASGFTFSDFYMSWVRQAPGKGLEWVANINYEGSSKYYVESVKGRFTISRDNAKNILYLQMNSLRAEDTAVYYCAREGDEGWYFDVWGQGTTVTVSS (S(SEQ ID NO.: 591) | DIQMTQSPSSLSASVGDRVTITCRASQSVSSALAWYQQKPGKAPKLLIYAASYRQSGVPSRFSGSGSGTDFTLTISSLQPEDFAVYYCQQHYSNPWTFGQGTKLEIK (S(SEQ ID NO.: 592) |
| 35 B21v36 | EVQLVESGGGLVQPGGSLRLSCAASGFTFSDFYMSWVRQAPGKGLEWVANINYEGSSKYYVESVKGRFTISRDNAKNILYLQMNSLRAEDTAVYYCAREGDEGWYFDVWGQGTTVTVSS (S(SEQ ID NO.: 593) | DIQMTQSPSSLSASVGDRVTITCRASQSISTAVAWYQQKPGKAPKLLIYAASYLYSGVPSRFSGSGSGTDFTLTISSLQPEDFAVYYCQQHYSNPWTFGQGTKLEIK (S(SEQ ID NO.: 594) |
| 36 B21v37 | EVQLVESGGGLVQPGGSLRLSCAASGFTFSDFYMSWVRQAPGKGLEWVANINYEGSSKYYVESVKGRFTISRDNAKNILYLQMNSLRAEDTAVYYCAREGDEGWYFDVWGQGTTVTVSS (S(SEQ ID NO.: 595) | DIQMTQSPSSLSASVGDRVTITCKASQSISTALAWYQQKPGKAPKLLIYAASYRYSGVPSRFSGSGSGTDFTLTISSLQPEDFAVYYCQQHYSNPWTFGQGTKLEIK (S(SEQ ID NO.: 596) |

TABLE 16-continued

CD137 B21 Variants

| CD137 Clone | VH | VK |
|---|---|---|
| 37 B21v38 | EVQLVESGGGLVQPGGSLRLSCAASGFTFSDFYMSWVR QAPGKGLEWVANINYEGSSKYYLESVKSRFTISRDNAK NILYLQMNSLRAEDTAVYYCAREGDEGWYFDVWGQGTT VTVSS (S(SEQ ID NO.: 597) | DIQMTQSPSSLSASVGDRVTITCRASQSVSTALAWYQQ KPGKAPKLLIYAASYLYTGVPSRFSGSGSGTDFTLTIS SLQPEDFAVYYCQQHYSNPWTFGQGTKLEIK (S(SEQ ID NO.: 598) |
| 38 B21v39 | EVQLVESGGGLVQPGGSLRLSCAASGFTFSDFYMSWVR QAPGKGLEWVANINYEGSSTYYVESVKGRFTISRDNAK NILYLQMNSLRAEDTAVYYCAREGDEGWYFDVWGQGTT VTVSS (S(SEQ ID NO.: 599) | DIQMTQSPSSLSASVGDRVTITCRASQDISTALAWYQQ KPGKAPKLLIYSASYLQSGVPSRFSGSGSGTDFTLTIS SLQPEDFAVYYCQQHYSNPWTFGQGTKLEIK (S(SEQ ID NO.: 600) |
| 39 B21v40 | EVQLVESGGGLVQPGGSLRLSCAASGFTFSDFYMAWVR QAPGKGLEWVANINYEGSSKYYLESLKGRFTISRDNAK NILYLQMNSLRAEDTAVYYCAREGDEGWYFDVWGQGTT VTVSS (S(SEQ ID NO.: 601) | DIQMTQSPSSLSASVGDRVTITCKASQSISTALAWYQQ KPGKAPKLLIYSASYLQSGVPSRFSGSGSGTDFTLTIS SLQPEDFAVYYCQQHYSNPWTFGQGTKLEIK (S(SEQ ID NO.: 602) |

From these thirty-nine IgGs, five exemplary candidates were selected and formatted as a bispecific "Doppelmab" in combination with sequence optimized FAP molecules.

n. Sequence Optimization of CD137 Candidate Clone CD137 #7 (A49)

An additional candidate molecule derived from humanized mouse Alivamab was evaluated. To sequence optimize the candidate, the potential deamidation liabilities NG to QG in light chain and NY to QY in the heavy chain variable region were mutated. Also, aggregation prone regions in the both chains were mutated to either L to G/A or I to M.

Eight optimized mutant constructs were generated and evaluated for binding to CD137 in the NFkB-Jurakat cell assay system (Promega) as described previously (see above).

TABLE 17

CD137 A49 Variants

| VARIANT | CD137 #A49 CLONE | VH | VK |
|---|---|---|---|
| P | A49 Parent | QVQLQESGPGLVKPSETLSLTCTVSGGSISSYYWS WIRQPPGKGLEWIGYIYYSGSTNYNPSLKSRVTIS VDTSKNQFSLKLSSVTAADTAVYYCARDQGGGSF QHWGQGTLVTVSS (SEQ ID NO.: 421) | EIVMTQSPLSLPVTPGEPASISCRSSQSLLYSNGYNHLDWYL QKPGQSPQLLIYLGSNRASGVPDRFSGSGSGTDFTLKISRVE AEDVGVYYCMQALQTPPTFGQGTKLEIK (SEQ ID NO.: 422) |
| 40 | A49v41 | QVQLQESGPGLVKPSETLSLTCTVSGGSISSYYWS WIRQPPGKGLEWIGYIYYSGSTNYNPSLKSRVTIS VDTSKNQFSLKLSSVTAADTAVYYCARDQGGGSF QHWGQGTLVTVSS (SEQ ID NO.: 603) | EIVMTQSPLSLPVTPGEPASISCRSSQSLLYSNAYNHLDWYL QKPGQSPQLLIYAGSNRASGVPDRFSGSGSGTDFTLKISRVE AEDVGVYYCMQALQTPPTFGQGTKLEIK (SEQ ID NO.: 604) |
| 41 | A49v42 | QVQLQESGPGLVKPSETLSLTCTVSGGSISSYYWS WIRQPPGKGLEWIGYIYYSGSTNYNPSLKSRVTIS VDTSKNQFSLKLSSVTAADTAVYYCARDQGGGSF QHWGQGTLVTVSS (SEQ ID NO.: 605) | EIVMTQSPLSLPVTPGEPASISCRSSQSLLYSQGYNHLDWYL QKPGQSPQLLIYGGSNRASGVPDRFSGSGSGTDFTLKISRVE AEDVGVYYCMQALQTPPTFGQGTKLEIK (SEQ ID NO.: 606) |
| 42 | A49v43 | QVQLQESGPGLVKPSETLSLTCTVSGGSISSYYWS WIRQPPGKGLEWMGYIYYSGSTNINPSLKSRVTIS VDTSKNQFSLKLSSVTAADTAVYYCARDQGGGSF QHWGQGTLVTVSS (SEQ ID NO.: 607) | EIVMTQSPLSLPVTPGEPASISCRSSQSLLYSNGYNHLDWYL QKPGQSPQLLIYLGSNRASGVPDRFSGSGSGTDFTLKISRVE AEDVGVYYCMQALQTPPTFGQGTKLEIK (SEQ ID NO.: 608) |
| 43 | A49v44 | QVQLQESGPGLVKPSETLSLTCTVSGGSISSYYWS WIRQPPGKGLEWMGYIYYSGSTQYNPSLKSRVTIS VDTSKNQFSLKLSSVTAADTAVYYCARDQGGGSF QHWGQGTLVTVSS (SEQ ID NO.: 609) | EIVMTQSPLSLPVTPGEPASISCRSSQSLLYSNAYNHLDWYL QKPGQSPQLLIYAGSNRASGVPDRFSGSGSGTDFTLKISRVE AEDVGVYYCMQALQTPPTFGQGTKLEIK (SEQ ID NO.: 610) |
| 44 | A49v45 | QVQLQESGPGLVKPSETLSLTCTVSGGSISSYYWS WIRQPPGKGLEWMGYIYYSGSTNINPSLKSRVTIS VDTSKNQFSLKLSSVTAADTAVYYCARDQGGGSF QHWGQGTLVTVSS (SEQ ID NO.: 611) | EIVMTQSPLSLPVTPGEPASISCRSSQSLLYSNAYNHLDWYL QKPGQSPQLLIYAGSNRASGVPDRFSGSGSGTDFTLKISRVE AEDVGVYYCMQALQTPPTFGQGTKLEIK (SEQ ID NO.: 612) |
| 45 | A49v46 | QVQLQESGPGLVKPSETLSLTCTVSGGSISSYYWS WIRQPPGKGLEWMGYIYYSGSTQYNPSLKSRVTIS VDTSKNQFSLKLSSVTAADTAVYYCARDQGGGSF QHWGQGTLVTVSS (SEQ ID NO.: 613) | EIVMTQSPLSLPVTPGEPASISCRSSQSLLYSNGYNHLDWYL QKPGQSPQLLIYLGSNRASGVPDRFSGSGSGTDFTLKISRVE AEDVGVYYCMQALQTPPTFGQGTKLEIK (SEQ ID NO.: 614) |

TABLE 17-continued

CD137 A49 Variants

| VARIANT | CD137 #A49 CLONE | VH | VK |
|---|---|---|---|
| 46 | A49v47 | QVQLQESGPGLVKPSETLSLTCTVSGGSISSYYWS WIRQPPGKGLEWMGYIYYSGSTNINPSLKSRVTIS VDTSKNQFSLKLSSVTAADTAVYYCARDQSGGGSF QHWGQGTLVTVSS (SEQ ID NO.: 615) | EIVMTQSPLSLPVTPGEPASISCRSSQSLLYSQGYNHLDWYL QKPGQSPQLLIYGGSNRASGVPDRFSGSGSGTDFTLKISRVE AEDVGVYYCMQALQTPPTFGQGTKLEIK (SEQ ID NO.: 616) |
| 47 | A49v48 | QVQLQESGPGLVKPSETLSLTCTVSGGSISSYYWS WIRQPPGKGLEWMGYIYYSGSTQYNPSLKSRVTIS VDTSKNQFSLKLSSVTAADTAVYYCARDQSGGGSF QHWGQGTLVTVSS (SEQ ID NO.: 617) | EIVMTQSPLSLPVTPGEPASISCRSSQSLLYSQGYNHLDWYL QKPGQSPQLLIYGGSNRASGVPDRFSGSGSGTDFTLKISRVE AEDVGVYYCMQALQTPPTFGQGTKLEIK (SEQ ID NO.: 618) |

Binding activity was expressed as luciferase activity (RLU) and plotted as a bar graph. Two positive controls based on known CD137 binders (Urelumab (BMS anti-CD137 Ab) and Utomilumab (Pfizer anti-CD137 Ab)) was compared to the eight CD137 binders isolated above, and were also compared other optimized candidates.

Example 3: Epitope Mapping Data of Anti-CD137 Binding Candidates

Figure 9:
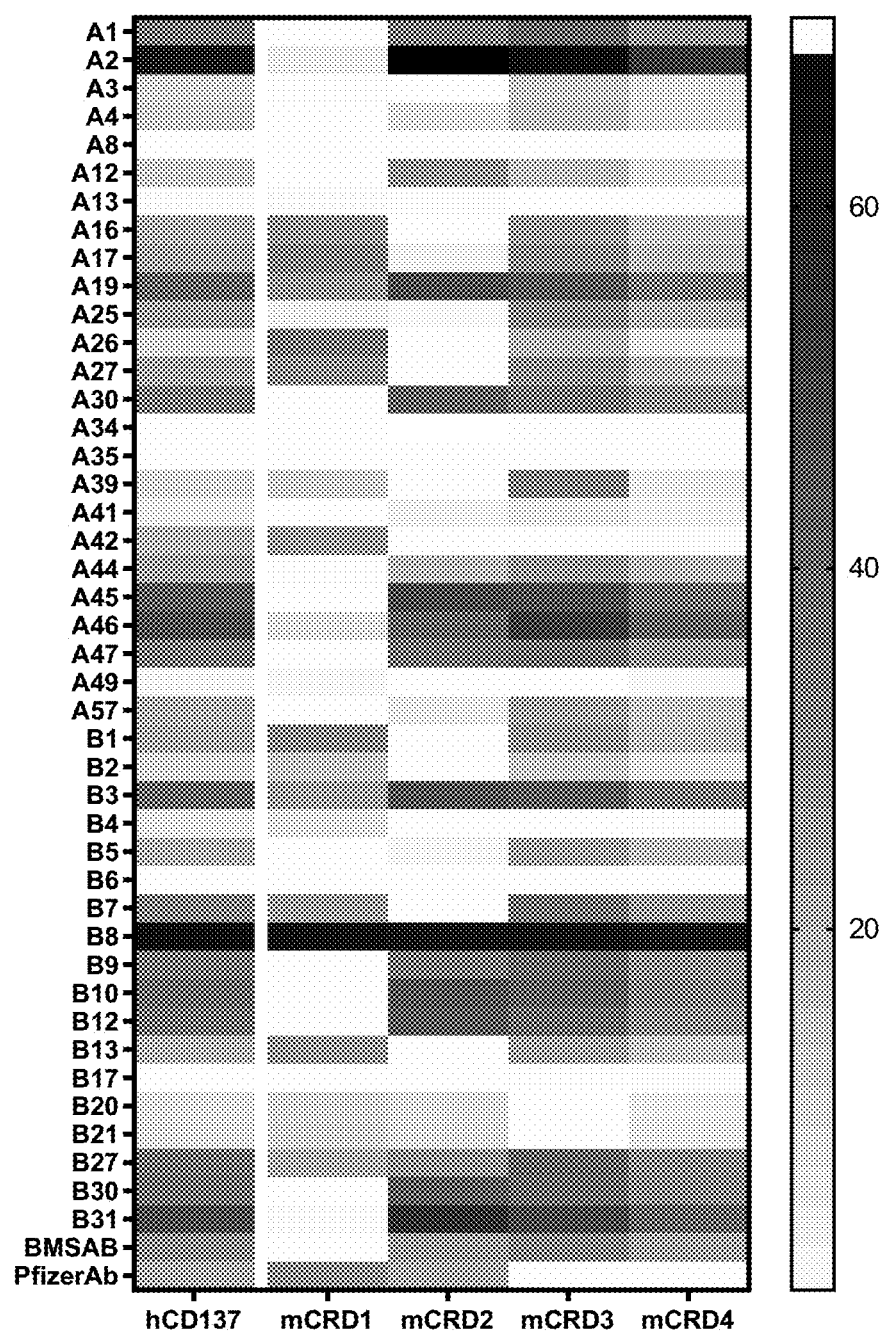
FIG. 9. Epitope mapping data of anti-CD137 binding candidates. CD137 antibodies were able to bind to a full-length human CD137-expressing Jurkat cell line, but binding was lost when the diverse human CRDs (huCD137) were systematically replaced by the mouse ones (mCRD1, mCRD2, mCRD3, and mCRD4). Each CD137 clone variant is labeled on the left hand panel. Epitope binding is graphically depicted as a gradient scale (as shown on the right hand side) where "black"=+ binding and "white"=no binding.

CD137 consists of four cysteine-rich domains (CRDs) termed CRD1, CRD2, CRD3 and CRD4 which are positioned distal to proximal to the cell membrane respectively. CRD1 refers to amino acids 24-45 of sequence Q07011 in Uniprot. CRD2 is formed by amino acids 47-86, CRD3 by amino acids 87-118 and CRD4 by amino acids 119-159. Jurkat cells expressing mouse and human CD137 chimeric proteins were generated by replacing the human CRDs with the corresponding mouse counterparts. CD137 antibodies were incubated with those recombinant cell lines and, upon addition of a fluorescently-labeled secondary antibody, binding was determined by flow cytometry. All antibodies were able to bind to a full-length human CD137-expressing Jurkat cell line, but binding was lost when the diverse human CRDs were replaced by the mouse ones. This approach allowed the inventors to elucidate the CRD where the different CD137 antibodies bind within the human CD137 protein (See FIG. 9).

By domain mapping, we have determined that the CD137 binders of the invention bind to CRD3 or the junction of CRD2/3. CD137 #1 and variants thereof bind to CRD3. CD137 #7 and variants thereof bind to the junction of CRD2/3. In contrast, the natural ligand for CD137, CD137L, binds to CRD2.

In order to address whether the binding of the natural CD137 ligand is altered by the invention we generated HEK293 cells expressing human CD137 Ligand (CD137-L) that were cultured together with Jurkat cells expressing human CD137. Activation of the NFkB pathway on those Jurkat cells was measured via luciferase activity. The invention does not compete with the functional activation induced by CD137L while other existing molecules Urelumab (BMS) and Utomilumab (Pfizer) and the FAP-targeted split trimeric 4-1BB ligand Fc fusion antigen binding molecule clone 2.11 (refers to the Roche split-trimeric 4-1BBL (71-248)/FAP(28H1) molecule Construct 2.11 described in WO2017194438 as SEQ ID NOs:113, 114, and 116 and corresponding to SEQ ID NOs: 663, 664, 665, and 666, contained herein) block the activation induced by CD137-L (FIGS. 10A and 10B).

a. Construction of Human Mouse Chimeras

Jurkat cells expressing chimeric version of CD137 were generated such that each human CRD regions was subsequently replaced by the equivalent mouse CRD region. Briefly, Jurkat cells expressing chimeric version of CD137 were generated such that each human CRD regions was subsequently replaced by the equivalent mouse CRD region.

For that purpose, lentiviral supernatants were produced upon transfection of 293FT cells with plasmids containing different modifications of the human CD137 cDNA. In those modified human CD137 sequences, the amino acids between cysteines in the human CRD1 or CRD2 or CRD3 or CRD4 had been replaced by the mouse counterpart. In particular, in one construct SEQ ID.:350, corresponding to amino acids 23-45 of human CRD1 was replaced by the murine CRD1 corresponding to SEQ ID NO.:360. In another construct, SEQ ID.:351 corresponding to amino acids 46-86 of human CRD2 was replaced by the murine CRD2 corresponding to SEQ ID NO.:361. In a third construct, SEQ ID.:352 corresponding to amino acids 87-118 of human CRD3 was replaced by the murine CRD3 corresponding to SEQ ID NO.:362. In a fourth construct, SEQ ID.:353 corresponding to amino acids 119-159 of human CRD4 was replaced by the murine CRD4 corresponding to SEQ ID NO.:363.

The plasmids also contained a puromycin-resistant gene allowing the selection of cells in which the construct is being expressed. In a 12-well plate, 2.5×10 5 293 FT cells were seeded per well in 1.5 mL of complete DMEM. The next day, the transfection mix was prepared by mixing 75 microliters of JetPRIME® transfection buffer (Polyplus Transfection), 0.5 μg DNA (CD137 plasmids) and 1 microliter of packaging mix (psPAX2, pMD2.G). After vortexing, 2 μl of JetPRIME® reagent were added and the mix were vortexed again. After 15 minutes at room temperature, the transfection mix was poured onto the cells (at 70-80% confluency). After 4 hours at 37° C., culture medium was replace by fresh medium. The next day, the virus supernatant was collected and, after addition of protamine sulfate, was subsequently used to transduce Jurkat cells. The positively-charged polycation protamine sulfate reduces the repulsion forces between the cell and the virus, resulting in a higher efficiency of transduction. Jurkat cells were incubated with lentivirus-containing supernatants and cultured for 48 hours at 37° C. in a $CO_2$ incubator. After that, puromycin (1 μg/ml final concentration) was added to select transduced cells. After two subsequent rounds of virus removal cells were used for determining the domains to which the different CD137-targeting antibodies bind to the human CD137 protein.

b. Binding of CD137 Candidates to Different Epitopes:

2×10 5 Jurkat cells expressing those variants of CD137, in 50 µl of buffer, were incubated with 50 µl CD137 antibody binders for 20 minutes at 4° C. After that, cells were washed twice to remove unbound antibodies and the samples were further incubated with a R-Phycoerythrin AffiniPure F(ab')$_2$ Fragment Donkey Anti-Human IgG (H+L). After an additional 20 minute incubation at 4° C. in the dark, samples were washed twice and fluorescence was measured in a flow cytometer (FACSCanto™ II Analyzer, BD Biosciences). Reduction or absence of binding to a particular modification of CD137 reflects lack of binding of the CD137 antibody when the human CRD has been replaced by the mouse counterpart.

duce 293FT cells. The positively-charged polycation protamine sulfate reduces the repulsion forces between the cell and the virus, resulting in a higher efficiency of transduction. 293FT cells (0.5×10 5 cells in 1.5 ml of medium) were incubated with lentivirus-containing supernatants and cultured for 48 hours at 37° C. in a $CO_2$ incubator. After that, puromycin (1 µg/ml final concentration) was added to select transduced cells. After two subsequent rounds of virus removal, expression of CD137-L was confirmed by flow cytometry in a FACSCanto® II analyzer (BD Biosciences).

d. Determination of CD137 Ligand Binding Blockade:

0.2×10 5 HEK293 cells expressing human CD137-L were seeded in a 96 well-plate. After a 30 minute incubation at

TABLE 18

| Epitope | Amino acid #s | Epitope SEQ ID NO.: | CD137 Clones that bind epitope (VH/VL) |
|---|---|---|---|
| CRD1 | 24-45 | SEQ ID NO.: 350 | A1 (SEQ ID NO.: 375, 376), A2 (SEQ ID NO.: 377, 378), A4 (SEQ ID NO.: 381, 382), A12 (SEQ ID NO.: 389, 390), A30 (SEQ ID NO.: 405, 406), A41 (SEQ ID NO.: 409, 410), A44 (SEQ ID NO.: 413, 414), A45 (SEQ ID NO.: 415, 416), A46 (SEQ ID NO.: 417, 418), A47 (SEQ ID NO.: 419, 420), B3 (SEQ ID NO.: 433, 434), B9 (SEQ ID NO.: 441, 442), B10 SEQ ID NO.: 443, 444), B12 (SEQ ID NO.: 445, 446), B30 (SEQ ID NO.: 461, 462), B31 (SEQ ID NO.: 463, 464), Urelumab (SEQ ID NO.: 371, 372) (BMS) |
| CRD1-2 | 23-86 | SEQ ID NO.:355 | A3 (SEQ ID NO.: 379, 380), A25 (SEQ ID NO.: 399, 400), A57 (SEQ ID NO.: 427, 428), B5 (SEQ ID NO.: 437, 438) |
| CRD2 | 47-861 | SEQ ID NO.:351 | A16 (SEQ ID NO.: 393, 394), A17 (SEQ ID NO.: 395, 396), A26 (SEQ ID NO.: 401, 402), A27 (SEQ ID NO.: 403, 404), A39 (SEQ ID NO.: 407, 408), B1 (SEQ ID NO.: 429, 430), B2 (SEQ ID NO.: 431, 432), B7 (SEQ ID NO.: 439, 440), B13(SEQ ID NO.: 447, 448) |
| CRD2-CRD3 | 46-117 | SEQ ID NO.: 356 | A49 (SEQ ID NO.: 421, 422) |
| CRD3 | 87-118 | SEQ ID NO.: 352 | B20 (SEQ ID NO.: 453, 454), B21 (SEQ ID NO.: 455, 456) |
| CRD3-4 | 88-158 | SEQ ID NO.: 357 | (Utomilumab (Pfizer) (SEQ ID NO.: 373, 374) |
| CRD4 | 119-159 | SEQ ID NO.: 353 | none |
| CRD2/CRD3/CRD4 | | SEQ ID NO.: 358 | A42 (SEQ ID NO.: 411, 412), B4 (SEQ ID NO.: 435, 436) |
| Outside CRDs(ECD) | | SEQ ID NO.: 1 | A19 (SEQ ID NO.: 298, 399), B27 (SEQ ID NO.: 457, 458) | c. Generation of Cells Expressing CD137 Ligand:

In a 12-well plate, 2.5×10 5 293 FT cells were seeded per well in 1.5 mL of complete DMEM. The next day, the transfection mix was prepared by mixing 75 µl of JetPRIME® Buffer, 0.5 µg DNA (CD137 plasmids) and 1 µl of packaging mix (psPAX2, pMD2.G). After vortexing, 2 µl of JetPRIME® reagent were added and the mix were vortexed again. After 15 minutes at room temperature, the transfection mix was poured onto the cells (at 70-80% confluency). After 4 hours at 37° C., culture medium was replace by fresh medium. The next day, the virus supernatant was collected and, after addition of protamine sulfate (4 µg/ml final concentration), was subsequently used to trans- 37° C. in a 5% CO2 incubator, 12.5 µl of a serial dilution of different CD137 binders were added to the CD137-L expressing cells. After a 30 minute incubation at 37° C. in a 5% CO2 incubator, Jurkat cells expressing human CD137 and a luciferase cDNA under the NFkB promoter (Promega) were added (0.2×10 5 cells per well). After a 5 hour incubation, plates were placed at room temperature for 10 minutes and 75 µl of Bio-Glo™ reagent (Promega) were added to each well Luminescence, as a measurement of Jurkat cell activation mediated by CD137L-CD137 interaction was detected with an EnVision® plate reader (Perkin-Elmer).

Example 4: Preparation of Binding Domains that Recognize Fibroblast Activation Protein (FAP)

Anti-FAP antibodies were generated using the OmniAb® platform (Crystal Biosciences) wherein transgenic chickens or OminChicken® are genetically engineered to express its genome immunoglobulin heavy and light chain loci containing human germline variable regions, VH and VL genes IgHV3-23*04/IgKV3-11*01, respectively, essentially as described in U.S. Pat. No. 9,404,125. Ten OmniChicken®, were immunized intramuscularly with 100 µg human FAP with Freund's complete adjuvant. Two weeks later, five of the ten birds received 100 µg human FAP with incomplete adjuvant, and five of the ten birds received 100 µg of murine FAP with incomplete adjuvant. Subsequent boosts were done every two weeks, with five of the ten birds receiving only human FAP, and five of the ten birds receiving alternating human and murine FAP. Cyno-FAP was not included in the immunization schedule because of the near 100% homology between human and cyno-FAP.

TABLE 19

| | Antigen domains used for immunization | | Percent Homology to Human FAP (%) |
|---|---|---|---|
| SEQ ID NO.: 4 | HUMAN FAP | NCBI: NP_004451 and Uniprot: Q12884 | 100 |
| | CYNO-FAP | XP_005573377 Gene ID: 102134935 | 99 |
| SEQ ID NO.: 5 | MURINE FAP | NCBI: NP_032012.1 and UniProt: P97321 | 89 |

As an alternative to mammalian species, birds (and in particular, chickens) present an attractive choice because they are phylogenetically distant from humans, produce antibodies of high affinity and specificity, and can recognize unique epitopes not accessible in mice. Expanded epitope coverage is an advantage in this case because of the enhanced chance of accessing functionally distinct regions of the target.

After immunization, serum from the immunized transgenic animals was isolated. Serum titers of antibodies specific to FAP were determined on the alternate weeks by ELISA. When sufficient titer was reached, a final boost of either 100 µg human FAP or 50 µg each of human and murine FAP was administered intravenously without adjuvant.

For making monoclonal antibodies specific for FAP, antibody-producing spleen cells were isolated from seven immunized transgenic birds, 4 days post final boost. cDNAs encoding FAP specific antibodies are cloned by standard molecular biology techniques and expressed in transfected cells. In vitro production of monoclonal antibodies from cloned cDNA molecules has been described by Andris-Widhopf et al., J. Immunol Methods 242:159 (2000), and by Burton, Immunotechnology 1:87 (1995), the disclosures of which are incorporated herein by reference.

a. Enriching for Species Cross-Reactive Clones with Immunization and Screening Strategies:

Initially gel encapsulated microenvironment (GEM) screens (Crystal Biosciences) were performed with splenocytes isolated from six birds with reporter beads; one reporter bead coated with human FAP and the other reporter bead coated with murine FAP, to select for cross-reactivity. Since human and cyno proteins are 99% homologous cyno screenings were not performed.

b. Generation of Cell Lines Stabling Expressing Human and Mouse FAP:

PAP is highly expressed on the cell surface of cancer-associated fibroblasts (CAFs), which represent a key component in the tumor microenvironment of many cancers. HT1080 is a fibrosarcoma cell line and been used extensively as a model for the potential role of FAP in the tumor microenvironment. HT1080 cells were transfected to express high levels of human FAR B16 melanoma is a murine tumor cell line useful for the study of metastasis and solid tumor formation. B16 cells were transfected to express high levels of murine FAR For that purpose, lentiviral supernatants were produced upon transfection of 293FT cells with plasmids containing the different species FAP cDNA. The plasmids also contained a puromycin-resistant gene, in order to allow the selection of cells in which the construct is being expressed. Per 10 cm culture plate, $5 \times 10^6$ 293FT cells were seeded in 10 mL of complete DMEM. The next day, the transfection mix was prepared by mixing 500 µl of JetPRIME® Buffer, 8 µg DNA (FAP plasmids) and 20 µl of packaging mix (psPAX2, pMD2.G). After vortexing, 36 µl of JetPRIME® reagent were added and the mix were vortexed again. After 15 minutes at room temperature, the transfection mix was poured onto the cells (at 70-80% confluency), After 4 hours at 37° C. culture medium was replace by fresh medium. The next day, the virus supernatant was collected and, after addition of protamine sulfate, was subsequently used to transduce HT-1080 or B16 cells. The positively-charged polycation protamine sulfate reduces the repulsion forces between the cell and the virus, resulting in a higher efficiency of transduction. HT-1080 or B16 cells at 30% confluency in T25 flasks (4 ml of complete medium) were incubated with lentivirus-containing supernatants and cultured overnight at 37° C. in a $CO_2$ incubator. The next day, cells were rinsed with PBS and resuspended in complete medium containing puromycin (1 µg/ml final concentration) to allow the selection of transduced cells. After two subsequent rounds of virus removal, FAP expression was confirmed by flow cytometry, by using a FACSCanto® II analyzer (BD Biosciences).

c. Reformatting FAP Antibodies to ScFv-Fc

As used herein the terms "single-chain Fv," "single-chain antibody," and "scFv" refer to a single-polypeptide-chain antibody fragment that comprise the variable regions from both the heavy and light chains, but lack the constant regions. Generally, a single-chain antibody further comprises a peptide linker connecting the VH and VL domains which enables it to form the desired structure to bind to antigen.

Single chain antibodies are discussed in detail by Pluckthun in The Pharmacology of Monoclonal Antibodies. vol. 113. Rosenburg and Moore eds. Various methods of generating single chain antibodies are known, e.g. as described in U.S. Pat. Nos. 4,946,778 and 5,260,203; International Patent Application Publication No. WO 88/01649; Bird (1988) Science 242:423-442; Huston et al. (1988) Proc. Natl. Acad. Sci. USA 85:5879-5883; Ward et al. (1989) Nature 5 334: 54454; Skerra et al. (1988) Science 242:1038-1041. In certain embodiments, at least one but preferably two scFv antibody fragments are associated an antibody Fc region.

A panel of FAP binding clones were identified and were formatted as ScFv-Fc and the molecules were purified using Protein A affinity chromatography and were checked for binding to human and mouse FAP expressing stable cell lines (FIGS. 9A, 9B, and 9C).

To construct the gene segment encoding the Fibroblast Activation Protein (FAP) scFv, pairs of VL and VH genes encoding Fibroblast Activation Protein (FAP)-binding variable domains were joined by a gene segment encoding a flexible linker of peptide sequence GGGGSGGGGSGGGGSGGGGS (SEQ ID NO.:282). The resulting scFv-encoding gene segments were in turn cloned in-frame to the 3' end of a gene encoding the heavy chain of an human IgG antibody. These coding segments were synthesized by overlapping PCR methods and cloned into the expression vector pTT5.

d. Recombinant FAP Proteins Binding to Human and Mouse FAP Expressing Cells.

Non FAP expressing cells HT-1080 and B16 were kept as controls. 149 FAP antibodies were identified and then triaged on the basis of % monomer (>85%) content after first step purification, Tm determination (>60° C.), and elution from analytical HIC column, a measure of hydrophobicity of different proteins (less than 9 minutes). Of the 149 candidates the following 11 antibodies were selected for generation of bispecific antibodies in combination with the selected anti-CD137 binders.

TABLE 20

FAP Specific Clones binding to Human and Murine FAP

| Clone | VH | VL | HUMAN MFI | MURINE MFI |
|---|---|---|---|---|
| FAP.65. F1 | DVQLVESGGGLVHPGGSLRLSCAASTFTF ANYIMSWVRQAPGKGLEWVSGITGSSTNT YYDS VKGRFTISRDNSKNTLYLEMNSLR AEDTAVYYCAKHQLYPYYAMDVWGQGTTV TVSS (SEQ ID NO.: 619) | EIVLTQSPGSLSLSPGERATLSCRASQPD SYL AWYQQKPGQAPRLLIYGASTRATDIPDRFSGSG SGTEFTLTISSLQSEDFAVYYCQQYYDWPPVT GGGTKVEIK (SEQ ID NO.: 620) | 35592 | 1840 |
| FAP.63. C10 | DVQLVESGGGVVRPGESLTLSCAASGFTF SSYDMGWVRQAPGEGLEWVSGIRGSGGST YYDS VKGRFTISRDSSKNTLYLQMNSLR AEDTAVYYCAKNN RHSFFEYWGLGTLVT VSS (SEQ ID NO.: 621) | EIVLTQSPGTLSLSPGERATLSCRASQSVGYYL AWYQQKPGQAPRLLIYDASNRASGISDRFSGSG SGTEFTLTISRLEPEDFAVYYCQQYNN WPPLT FGGGTKVEIK (SEQ ID NO.: 622) | 49714 | 879 |
| FAP.63. G3 | DVQLVESGGGVVRPGESLTLSCAASGFTF SNYDMGWVRQAPGEGLEWVSGIRGRGGST YYDS VKGRFTISRDSSKNTLYLQMNSLR AEDTAVYYCAKNN RHSFFEYWGLGTLVT VSS (SEQ ID NO.: 623) | EIVLTQSPGTLSLSPGERATLSCRASQSVGHYL AWYQQKPGQAPRLLIYDASNRAIDIPDRFSGSG SGTEFTLTISRLEPEDFAVYYCQQYNN WPPLT FGGGTKVEIK (SEQ ID NO.: 624) | 72776 | 1406 |
| FAP.63. D7 | DVQLVESGGGVVRPGESLRLSCAASGFTF SSYAMSWVRQTPGEGLEWVSFISSGGAYT HYDS VKGRFTISRDNSKNTLYLYLMNSLR AEDTAVYYCAKEKEIWNAFFDYWGLGTLV TVSS (SEQ ID NO.: 625) | EIVLTQSPATLNLS PGDRATLTCRASQTVGSKL AWYQQTSGQAPRLLIYDASSRATGIPDRFSGSG SGTEFTLTISSLEPEDFAVYVCQQYYDWPPLTF GGGTKVEIK (SEQ ID NO.: 626) | 49103 | 3356 |
| FAP.63. H3 | DVQLVESGGGVVRPGESLRLSCAASGFTF SSYDMGWVRQAPGEGLEWVSGIRVSGGST YYDS VKGRFTISRDSSNNTLYLQMNSLR AEDTALYYCAKENDRHSFFEYWGLGTLVT VSS (SEQ ID NO.: 627) | EIVLTQSPGTLSLSPGERATLSCRASQSVGYYL AWYQQKPGQAPRLLIYDASDRATAIPDRFSGSG SGTEFTLTISRLEPEDFAVYYCQQYNN WPPLT FGGGTKVEIK (SEQ ID NO.: 628) | 75000 | 2834 |
| FAP.84. A11 | DVQLVESGGGLVQPGGSLRLSCAASGFSM SNFAMTWVRQAPGEGLEWVSGIRGSGTTY YADSVKGRFTVSRDNSKNTLYLQMNSLRA EDTAIYYCAKTWGTEYFDYWGLGTLVTVS S (SEQ ID NO.: 629) | EIVLTQSPGTLSLSPGERATLSCRASQPINNYL AWYQQKPGQAPRLLIYAASNRATGIPDRFSGSG SGTEFTLTISSLEPEDFAVYYCQQYYDWPPYTF GGGTKVEIK (SEQ ID NO.: 630) | 27337 | 1406 |
| FAP.84. B2 | DVQLVESGGGVVRPGESLRLSCAASGFSF SSYAMNWVRQAPGKGLEWVSAISGSGGGT FYADSVKGRFTISRDNSKNTLYLQMNSLR AEDTAIYYCAKDPFGYGFFDSWGLGTLVT VSS (SEQ ID NO.: 631) | EIVMTQSPATLSVSPGDRATLSCRASQTVGSKL AWYQQKPGQAPRLLIYAASSRATGIPDRFSGSG SGTDFTLTISSLEPEDFAVYYCQQYYNWPPAFG GGTKVEIK (SEQ ID NO.: 632) | 17267 | 2255 |
| FAP.84. B7 | DVQLVESGGGVVRPGESLRLSCAASGFIF RNYAMTWVRQAPGEGLEWVSTIRSSGSGR TDTYYDS VKGRFTISRDSNNT LYLQMN SLRAEDTAVYYCAKSGTFWDTFFDYWGLG TLVTVSS (SEQ ID NO.: 633) | EIVLTQNPGTLNLS PGERATLTCRASQSAGRNL AWYQQKPGQTPRLLIYDWT RATGIPDRFSGSG SGTENLT ISSLQNEDFAVYYCQQNN WPPLTF GGGTKVEIK (SEQ ID NO.: 634) | 24025 | 1606 |
| FAP.84. B8 | DVQLVESGGSVVRPGESLRLSCAASGFPF SSYPMTWVRQAPGEGLEWVSSIRGSGDRI HYADSVKGRFTISKDSSNNTLYLQMNSLR AEDTAVYYCATGWNFFDYWGLGTLVTVSS (SEQ ID NO.: 635) | EIVLTQSPGTLSLSPGERATLSCRASQTVATYL AWYQQKPGQAPRLLIYAAISRATGIPDRFSGSG SGTDFTLTITRLEPEDSAVYYCQQYKDWPPLTF GGGTKVEIK (SEQ ID NO.: 636) | 24251 | 1492 |
| FAP.84. A9 | DVQLVESGGGVVRPGGSLRLSCAASGFPF SSYPMTWVRQAPGEGLEWVSSIRPIGDRI HYADSVKGRFTISRDSSNNTLYLQMNSLR AEDTAVYYCATGWNFFDYWGLGTLVTVSS (SEQ ID NO.: 637) | EIVLTQSPGTLSLSPGERATLSCRASQTVATYL AWYQQKPGQAPRLLIYAAISRATGIPDRFIGSG SGTDFTLTINRLEPEDFAVYYCQQYKDWPPLTF GGGTKVEIK (SEQ ID NO.: 638) | 25383 | 1304 |

TABLE 20-continued

FAP Specific Clones binding to Human and Murine FAP

| Clone | VH | VL | HUMAN MFI | MURINE MFI |
|---|---|---|---|---|
| FAP.84. C11 | DVQLVESGGGVVRPGESLRLSCAASGFTF SSYDMSWVRQAPGEGLEWVSAISGSGDRI HYDSVKGRFTISRDNSKNTLYLQMNSLR AEDTAVYYCAKDLRYYSGSPVFDYWGLGT LVTVSS (SEQ ID NO.: 639) | EIVLTQSPGTLSLSPGERAILSCRASQTVGSRL AWYQQKPGQAPRLLIYAASSRATGIPDRFSGSG SGTEFTLTISSLQSEDFAVYYCQQYYDWPPLTF GGGGTKVEIK (SEQ ID NO.: 640) | 27001 | 1427 |

Example 5: Generation of Bispecific Constructs Targeting CD137 and Fibroblast Activation Protein (FAP)

The pairs of VL and VH genes encoding the anti-CD137 (4-1BB, TNFRSF9)-antibody Urelumab, as previously discussed above, were then formatted into the bispecific format outlined in Example 1. The VH genes were cloned into pTT5 expression vector as an in frame fusion at the 5' end of a gene encoding human Igγ. Eleven FAP candidates (Table 20) were chosen and formatted as bispecific molecules wherein the gene encoding a Fibroblast Activation Protein (FAP)-binding scFv was cloned in frame at the 3' end of the same Igγ encoding segment. Similarly, the VL genes were cloned into pTT5 expression vector as an in-frame fusion with a gene encoding human IgG kappa light chain. The Leu234Ala and Leu235Ala mutations were introduced in the constant regions of the heavy chain to abrogate biding to Fc-gamma receptors (See WO2012/130831). A schematic diagram of the resulting bispecific, bivalent constructs is shown in FIG. 1A.

a. Selection of FAP Clones:

The Table below shows the amino acid sequences of mature bispecific, bivalent anti-CD137 (Urelumab)/FAP antibodies that were used for screening FAP activity.

TABLE 21

Bispecific Clones FAP-Urelumab

| Bispecific Clone | VH-LINKER-VL FAP | VH CD137 + VL CD137 (URELUMAB) |
|---|---|---|
| FAP.65.F1 | EIVLTQSPGSLSLSPGERATLSCRASQPIDSYLAWYQQKP GQAPRLLIYGASTRATDIPDRFSGSGSGTEFTLTISSLQS EDFAVYYCQQYYDWPPVTFGGGTKVEIKGGGGSGGGGSGG GGSGGGGSDVQLVESGGGLVHPGGSLRLSCAASTFTFANY IMSWVRQAPGKGLEWVSGITGSSTNTYYTDSVKGRFTISR DNSKNTLYLEMNSLRAEDTAVYYCAKHQLYPYYAMDVWGQ GTTVTVSS (SEQ ID NO.: 641) | SEQ ID NOS.: 371, 372 |
| FAP.63.C10 | EIVLTQSPGTLSLSPGERATLSCRASQSVGYYLAWYQQKP GQAPRLLIYDASNRASGISDRFSGSGSGTEFTLTISRLEP EDFAVYYCQQYYNNWPPLTFGGGTKVEIKGGGGSGGGGSG GGGSGGGGSDVQLVESGGGVVRPGESLTLSCAASGFTFSS YDMGWVRQAPGEGLEWVSGIRGSGGSTYYADSVKGRFTIS RDSSKNTLYLQMNSLRAEDTAVYYCAKENNRHSFFEYWGL GTLVTVSS (SEQ ID NO.: 642) | SEQ ID NOS.: 371, 372 |
| FAP.63.C3 | EIVLTQSPGTLSLSPGERATLSCRASQSVGHYLAWYQQKP GQAPRLLIYDASNRAIDIPDRFSGSGSGTEFTLTISRLEP EDFAVYYCQQYYNNWPPLTFGGGTKVEIKGGGGSGGGGSG GGGSGGGGSDVQLVESGGGVVRPGESLTLSCAASGFTFSN YDMGWVRQAPGEGLEWVSGIRGRGGSTYYADSVKGRFTIS RDSSKNTLYLQMNSLRAEDTAVYYCAKENNRHSFFEYWGL GTLVTVSS (SEQ ID NO.: 643) | SEQ ID NOS.: 371, 372 |
| FAP.63.D7 | E1VLTQSPATLNLSPGDRATLTCRASQTVGSKLAWYQQTS GQAPRLLIYDASSRATGIPDRFSGSGSGTEFTLTISSLEP EDFAVYVCQQYYDWPPLTFGGGTKVEIKGGGGSGGGGSGG GGSGGGGSDVQLVESGGGVVRPGESLRLSCAASGFTFSSY AMSWVRQTPGEGLEWVSFISSGGAYTHYTDSVKGRFTISR DNSKNTLYLQMNSLRAEDTAVYYCAKEKEIWNAFFDYWGL GTLVTVSS (SEQ ID NO.: 644) | SEQ ID NOS.: 371, 372 |
| FAP.63.H3 | EIVLTQSPGTLSLSPGERATLSCRASQSVGYYLAWYQQKP GQAPRLLIYDASDRATAIPDRFSGSGSGTEFTLTISRLEP EDFAVYYCQQYYNNWPPLTFGGGTKVEIKGGGGSGGGGSG GGGSGGGGSDVQLVESGGGVVRPGESLRLSCAASGFTFSS YDMGWVRQAPGEGLEWVSGIRVSGGSTYYADSVKGRFTIS RDSSNNTLYLQMNSLRAEDTALYYCAKENDRHSFFEYWGL GTLVTVSS (SEQ ID NO.: 645) | SEQ ID NOS.: 371, 372 |
| FAP.84.A11 | EIVLTQSPGTLSLSPGERATLSCRASQPINNYLAWYQQKP GQAPRLLIFSASNRATGIPDRFSGSGSGTEFTLTISSLEP EDFAVYYCQQYYDWPPYTFGGGTKVEIKGGGGSGGGGSGG | SEQ ID NOS.: 371, 372 |

TABLE 21-continued

Bispecific Clones FAP-Urelumab

| Bispecific Clone | VH-LINKER-VL FAP | VH CD137 + VL CD137 (URELUMAB) |
|---|---|---|
| | GGSGGGGSDVQLVESGGGLVQPGGSLRLSCAASGFSMSNF<br>AMTWVRQAPGEGLEWVSGIRGSGTTYYADSVKGRFTVSRD<br>NSKNTLYLQMNSLRAEDTAIYYCAKTWGTEYFDYWGLGTL<br>VTVSS (SEQ ID NO.: 646) | |
| FAP.84.B2 | EIVMTQSPATLSVSPGDRATLSCRASQTVGSKLAWYQQKP<br>GQAPRLLIYAASSRATGIPDRFSGSGSGTDFTLTISSLEP<br>EDFAVYYCQQYYNWPPAFGGGTKVEIKGGGGSGGGGSGGG<br>GSGGGGSDVQLVESGGGVVRPGESLRLSCAASGFSFSSYA<br>MNWVRQAPGKGLEWVSAISGSGGGTFYADSVKGRFTISRD<br>NSKNTLYLQMNSLRAEDTAIYYCAKDPFGYGFFDSWGLGT<br>LVTVSS (SEQ ID NO.: 647) | SEQ ID NOS.: 371, 372 |
| FAP.84.B7 | EIVLTQNPGTLNLSPGERATLTCRASQSAGRNLAWYQQKP<br>GQTPRLLIYDVNTRATGIPDRFSGSGSGTEFNLTISSLQN<br>EDFAVYYCQQYNNWPPLTFGGGTKVEIKGGGGSGGGGSGG<br>GGSGGGGSDVQLVESGGGVVRPGESLRLSCAASGFIFRNY<br>AMTWVRQAPGEGLEWVSTIRSSGSGRTDTYYADSVKGRFT<br>ISRDSSNNTLYLQMNSLRAEDTAVYYCAKSGTFWDTFFDY<br>WGLGTLVTVSS (SEQ ID NO.: 648) | SEQ ID NOS.: 371, 372 |
| FAP.84.B8 | EIVLTQSPGTLSLSPGERATLSCRASQTVATYLAWYQQKP<br>GQAPRLLIYAAISRATGIPDRFSGSGSGTDFTLTITRLEP<br>EDSAVYYCQQYKDWPPLTFGGGTKVEIKGGGGSGGGGSGG<br>GGSGGGGSDVQLVESGGSVVRPGESLRLSCAASGFPFSSY<br>PMTWVRQAPGEGLEWVSSIRGSGDRIHYADSVKGRFTISK<br>DSSNNTLYLQMNSLRAEDTAVYYCATGWNFFDYWGLGTLV<br>TVSS (SEQ ID NO.: 649) | SEQ ID NOS.: 371, 372 |
| FAP.84.A9 | EIVLTQSPGTLSLSPGERATLTCRASQTVATYLAWYQQKP<br>GQAPRLLIYAAISRATGIPDRFIGSGSGTDFTLTINRLEP<br>EDFAVYYCQQYKDWPPLTFGGGTKVEIKGGGGSGGGGSGG<br>GGSGGGGSDVQLVESGGGVVRPGGSLRLSCAASGFPFSSY<br>PMTWVRQAPGEGLEWVSSIRPIGDRIHYADSVKGRFTISR<br>DSSNNTLYLQMNSLRAEDTAVYYCATGWNFFDYWGLGTLV<br>TVSS (SEQ ID NO.: 650) | SEQ ID NOS.: 371, 372 |
| FAP84.C11 | EIVLTQSPGTLSLSPGERAILSCRASQTVGSRLAWYQQKP<br>GQAPRLLIYAASSRATGIPDRFSGSGSGTEFTLTISSLQS<br>EDFAVYYCQQYYDWPPLTFGGGTKVEIKGGGGSGGGGSGG<br>GGSGGGGSDVQLVESGGGVVRPGESLRLSCAASGFTFSSY<br>DMSWVRQAPGEGLEWVSAISGSGDRIHYADSVKGRFTISR<br>DNSKNTLYLQMNSLRAEDTAVYYCAKDLRYYSGSPVFDYW<br>GLGTLVTVSS (SEQ ID NO.: 651) | SEQ ID NOS.: 371, 372 |

In-Fusion® HD Cloning Kit (Clonetech, U.S.A.) was used in the above procedure for directional cloning of VH and VL genes. PCR primers for VL/VH with 15 bp extensions complementary to the ends of the linearized vector were synthesized. PCR was performed using the manufacturer's standard protocol and the amplicons were purified or treated with Cloning Enhancer, then cloned into the appropriate vector. E. coli were then transformed according to manufacturer's instructions (Clonetech, U.S.A.). DNA minipreps were sequenced.

Each expression vector contains eukaryotic promoter elements for the chain-encoding gene, the gene encoding the signal sequence and the heavy or light chain, an expression cassette for a prokaryotic selection marker gene such as ampicillin, and an origin of replication. These DNA plasmids were propagated in ampicillin resistant E. coli colonies and purified.

b. Expression and Purification of Bispecific, Tetravalent Molecules Recognizing Human CD137 (4-1BB, TNFRSF9) and Human Fibroblast Activation Protein (FAP)

The expression vectors prepared as above example were transfected into CHO-E cells. Transfected CHO-E cells growing in suspension in serum-free media were cultivated in shake flasks under agitation at 140 rpm, 37° C. and 5% $CO_2$ and kept at conditions of exponential growth. On the day of transfection, cells were chemically transfected with 1 mg of light chain plasmid and 0.5 mg of heavy chain plasmid. They were then seeded at 1 to 2×10 6 cells/ml in 1 L of Gibco® FreeStyle™ CHO expression medium (LifeTechnologies, NY, US). Cells were then incubated under orbital shaking for 10 to 12 days with one-time feeding of 150 ml commercial feed solution to allow expression of the proteins. Antibody titers in the cell culture supernatants were determined using an Octet® instrument (Pall ForteBio, CA, US) and protA biosensor tips according to manufacturer's instructions.

Recombinant antibodies were purified from culture supernatant by Protein A affinity chromatography using MabSelect™ (Amersham Biosciences) and stored in 60 mM NaOAc buffer (pH 5.0). Purity and degree of heterogeneity of the samples were assessed by mass spectrometry and analytical ultracentrifugation. All samples were confirmed to have a monomer content of ≥90% and contain <10% impurities prior to functional testing.

c. Functional Activity of CD137/FAP Bispecific Abs.

A T cell fibroblast co-culture-assay was used to demonstrate T cell activation specific to FAP-mediated CD137-crosslinking.

Briefly, FAP+HT1080 and HT1080 parental cells were plated in culture medium (RPMI1640/Glutamax, Gibco 61870-010; plus 10% FCS, Gibco 26140). After resting overnight at 37° C. and 5% $CO_2$, cells were incubated with CD137+ Jurkat cells for 24 h with 50 µl of different antibody dilutions at the desired concentrations. NFκB reporter gene activity was assessed by using the CellTiter-Glo® Luminescent Cell Viability Assay (Promega G7571) according to the instructions provided by the manufacturer. Finally, luminescence was recorded using the VICTOR™ X4 2030 Multi-label Plate Reader from Perkin Elmer.

Using the Luciferase reporter assay system, inventors confirmed that CD137/FAP bi-specific molecules of the invention only activate Jurkat cells in the presence of FAP-positive cells but not the presence of FAP negative cells (FIG. 12A-C). This was in contrast to Urelumab which activates Jurkat cells at a similar extent in presence of FAP-positive and FAP-negative cells (FIG. 12B). In this assay system, Utomilumab did not show any activity (FIG. 12C).

On the basis of activity in NFκB-Jurkat assays, three clones FAP84.A11 (VH, VL SEQ ID NOs.:629, 630, respectively), FAP84.B8 (VH, VL SEQ ID NOs.:635, 636, respectively), and FAP 63.C3 (VH, VL SEQ ID NOs:623, 624, respectively) were identified as optimized FAP candidates. Of these, two FAP molecules were made as doppelmabs with candidate clones CD137 #B21 and CD137 #A49 resulting in four different parent bispecific constructs. The sequences corresponding to the four parental bispecific are provided in Table 24, rows 1-4. A pre-formulation assessment for developability was performed on the four initial proteins (See Table 22).

Example 6: Details of the Bispecific Molecules Recognizing Human CD137 (4-1BB, TNFRSF9) and Human Fibroblast Activation Protein (FAP) Molecules Prepared In the following examples a number of different bispecific CD137 (4-1BB, TNFRSF9)/Fibroblast Activation Protein (FAP) antibody molecules of the invention were prepared. To avoid confusion, the characteristics and sequences of these molecules are provided below.

a. Sequence Optimization of FAP

For sequence optimizations of FAP84.A11 ("FAP #1") and FAP63.C3 ("FAP #4") parental variants, point mutations at the potential liability sites were made in the human frameworks. Described below are sequences for the FAP candidates.

TABLE 23

Binding values to human and mouse FAP proteins.

| Molecule | Description | KD on human FAP (pM) | KD on mouse FAP | EpiVax Score |
|---|---|---|---|---|
| FAP-A11 parental | FAP-A11SCFV(WT) | 1040 | <20 pM | −38.45 |
| FAP-A11 VK1-VH13 | FAP-A11VK1VH13 (ST, QQQ) | 2880 | <20 pM | −26.65 |
| FAP-A11 VK3-VH1 | FAP-A11VK3VH1 (RS, NNN) | 199 | <20 pM | −37.95 |
| FAP-A11 VK3-VH13 (FAP #2) | FAP-A11VK3VH13 (RS, QQQ) | 538 | <20 pM | −25.46 |
| FAP-A11 VK7-VH1 (FAP #3) | FAP-A11VK7VH1 (SS, NNN) | 1500 | <20 pM | −40.05 |
| FAP-C3 parental | FAP-C3SCFVWT | 36 | 33 nM | −52.72 |

TABLE 22

| | | CD1137 clone/FAP clone | | | |
|---|---|---|---|---|---|
| Attribute | Assay | B21 + A11 CD137#1/ FAP#1 Row 1, Table 23 | A49 + A11 CD137 #7/ FAP #1 Row 2, Table 23 | B21 + C3 CD137 #1/ FAP#2 Row 3, Table 23 | A49 + C3 CD137 #7/ FAP #2 Row 4, Table 23 |
| Manufacturability | Titer::Yield (%) | 66 | 69 | 50 | 69 |
| Quality/Purity | Analytical Size Exclusion Chromatography (% Main) | 99 | 100 | 99 | 100 |
| | Analytical Hydrophobic Interaction Chromatography (% Main) | 98 | 100 | 96 | 100 |
| | Hydrodynamic Radius ($R_H$ nm) and Polydispersity (% PD) | 6, 16 | 6, 18 | 6, 14 | 6, 11 |
| Conformational Stability | Thermal Stability Analysis (TSA) (Tm, ° C.) | 66; 85 | 67; 85 | 68; 85 | 67; 85 |
| Colloidal Interactions | Reversible Self-Association Aggregation Onset Temperature (Tagg; ° C. and size) | DSB: Fav Phys: Fair 56; mod | DSB: Fair Phys: Fair 58; small | DSB: Excpt Phys: Excpt 61; mod | DSB: Fav Phys: Excpt 60; small |

TABLE 23-continued

Binding values to human and mouse FAP proteins.

| Molecule | Description | KD on human FAP (pM) | KD on mouse FAP | EpiVax Score |
|---|---|---|---|---|
| FAP-C3 VK1-VH14 (FAP #5) | FAP-C3VK1VH14 (ND, SY, ES, ES, ER) | 24 | 4.6 nM | −55.22 |
| FAP-C3 VK1-VH15 | FAP-C3VK1VH15 (ND, SY, ES, DS, ER) | 25 | 5.3 nM | −59.95 |

On the basis of activity in functional assays, 3 anti-FAP candidates were identified FAP-A11-VK3-VH13 or "FAP #2", FAP-A11-VK7-VH1, or "FAP #3" and FAP-C3-VK1-VH4 or "FAP #5" and formatted with 8 sequence optimized anti-CD137 binding molecules (B21 variants V.16 ("CD137 #2), V.22 ("CD137 #3"), V.25 ("CD137 #4"), V.29 ("CD137 #5"), V.37 ("CD137 #6"), and A49 variants V.43 ("CD137 #8"), V.47 ("CD137 #9"), and V.48 ("CD137 #10")) as described in Table 24, below) resulting in 24 CD137-FAP bispecific molecules.

TABLE 24

Details of the bispecific CD137 (4-1BB, TNFRSF9)/Fibroblast Activation Protein (FAP) molecules of the invention

| | Name | CD137 (4-1BB, TNFRSF9) binding domain (VH/VL) | Fibroblast Activation Protein (FAP) binding domain (VH/VL) | (CD137 VH-Fc)-L1-(VL-L2-VH FAP-ScFV) | CD137 LC/FAB | FAP scFV orientation and sequence VL-L2-VH |
|---|---|---|---|---|---|---|
| 1 | CD137 #1 (B21 PARENT) + FAP #1 (A.11 PARENT) | SEQ ID NOS: 10, 15 (SEQ ID NO.: 455, 456 TABLE 16) | SEQ ID NOS: 106, 110 | SEQ ID NO.: 151 | SEQ ID NO.: 152 | VL-L2-VH SEQ ID NO.: 114 |
| 2 | CD137 #7 (A49 PARENT) + FAP #1 (A.11PARENT) | SEQ ID NOS: 70, 75 (SEQ ID NO.: 421, 422 TABLE 16) | SEQ ID NOS: 106, 110 | SEQ ID NO.: 153 | SEQ ID NO.: 154 | VL-L2-VH SEQ ID NO.: 114 |
| 3 | CD137 #1 (B21 PARENT) + FAP#4 (C3 PARENT) | SEQ ID NOS: 10, 15 (SEQ ID NO.: 455, 456 TABLE 16) | SEQ ID NOS: 133, 137 | SEQ ID NO.: 155 | SEQ ID NO.: 156 | VL-L2-VH SEQ ID NO.: 141 |
| 4 | CD137 #7 (A49) + FAP #4 (C3 PARENT) | SEQ ID NOS: 70, 75 (SEQ ID NO.: 421, 422 TABLE 16) | SEQ ID NOS: 133, 137 | SEQ ID NO.: 157 | SEQ ID NO.: 158 | VL-L2-VH SEQ ID NO.: 141 |
| 5 | CD137 #2 (B21.V16) + FAP #5 (C3 VK1/VH4) | SEQ ID NOS: 20, 25 (SEQ ID NO.: 555, 556 TABLE 16) | SEQ ID NOS: 142, 146 | SEQ ID NO.: 159 | SEQ ID NO.: 160 | VL-L2-VH SEQ ID NO.: 163 |
| 6 | CD137 #2 (B21.V16) + FAP#2 (A11 VK3/VH3) | SEQ ID NOS: 20, 25 (SEQ ID NO.: 555, 556 TABLE 16) | SEQ ID NOS: 115, 119 | SEQ ID NO.: 164 | SEQ ID NO.: 165 | VL-L2-VH SEQ ID NO.: 168 |
| 7 | CD137 #2 (B21.V16) + FAP #3 (A11 VK7/VH1) | SEQ ID NOS: 20, 25 (SEQ ID NO.: 555, 556 TABLE 16) | SEQ ID NOS: 124, 128 | SEQ ID NO.: 169 | SEQ ID NO.: 171 | VL-L2-VH SEQ ID NO.: 173 |
| 8 | CD137 #3 (B21.V22) + FAP #5 (C3 VK1/VH4) | SEQ ID NOS: 30, 35 (SEQ ID NO.: 565, 566 TABLE 16) | SEQ ID NOS: 142, 146 | SEQ ID NO.: 174 | SEQ ID NO.: 175 | VL-L2-VH SEQ ID NO.: 178 |
| 9 | CD137 #3 (B21.V22) + FAP #2 (A11 VK3/VH3) | SEQ ID NOS: 30, 35 (SEQ ID NO.: 565, 566 TABLE 16) | SEQ ID NOS: 115, 119 | SEQ ID NO.: 179 | SEQ ID NO.: 180 | VL-L2-VH SEQ ID NO.: 183 |
| 10 | CD137 #3 (B21.V22) + FAP #3 (A11 VK7/VH1) | SEQ ID NOS: 30, 35 (SEQ ID NO.: 565, 566 TABLE 16) | SEQ ID NOS: 124, 128 | SEQ ID NO.: 184 | SEQ ID NO.: 185 | VL-L2-VH SEQ ID NO.: 188 |
| 11 | CD137 #4 (B21.V25) + FAP #5 (C3 VK1/VH4) | SEQ ID NOS: 40, 45 (SEQ ID NO.: 571, 572 TABLE 16) | SEQ ID NOS: 142, 146 | SEQ ID NO.: 189 | SEQ ID NO.: 190 | VL-L2-VH SEQ ID NO.: 193 |
| 12 | CD137 #4 (B21.V25) + FAP #2 (A11 VK3/VH3) | SEQ ID NOS: 40, 45 (SEQ ID NO.: 571, 572 TABLE 16) | SEQ ID NOS: 115, 119 | SEQ ID NO.: 194 | SEQ ID NO.: 195 | VL-L2-VH SEQ ID NO. 198 |
| 13 | CD137 #4 (B21.V25) + FAP #3 (A11 VK7/VH1) | SEQ ID NOS: 40, 45 (SEQ ID NO.: 571, 572 TABLE 16) | SEQ ID NOS: 124, 128 | SEQ ID NO.: 199 | SEQ ID NO.: 200 | VL-L2-VH SEQ ID NO. 203 |
| 14 | CD137 # 5 (B21.V29) + FAP #5 (C3 VK1/VH4) | SEQ ID NOS: 50, 55 (SEQ ID NO.: 579, 580 TABLE 16) | SEQ ID NOS: 142, 146 | SEQ ID NO.: 204 | SEQ ID NO.: 205 | VL-L2-VH SEQ ID NO. 208 |
| 15 | CD137 #5 (B21 V29) + FAP #2 (A11 VK3/VH3) | SEQ ID NOS: 50, 55 (SEQ ID NO.: 579, 580 TABLE 16) | SEQ ID NOS: 115, 119 | SEQ ID NO.: 209 | SEQ ID NO.: 210 | VL-L2-VH SEQ ID NO. 213 |
| 16 | CD137 #5 (B21.V29) + FAP #3 (A11 VK7/VH1) | SEQ ID NOS: 50, 55 (SEQ ID NO.: 579, 580 TABLE 16) | SEQ ID NOS: 124, 128 | SEQ ID NO.: 214 | SEQ ID NO.: 215 | VL-L2-VH SEQ ID NO. 218 |
| 17 | CD137 #6 (B21.V37) + FAP #5 (C3 VK1/VH4) | SEQ ID NOS: 60, 65 (SEQ ID NO.: 595, 596 TABLE 16) | SEQ ID NOS: 142, 146 | SEQ ID NO.: 219 | SEQ ID NO.: 220 | VL-L2-VH SEQ ID NO. 223 |
| 18 | CD137 #6 (B21.V37) + FAP #2 (A11 VK3/VH3) | SEQ ID NOS: 60, 65 (SEQ ID NO.: 595, 596 TABLE 16) | SEQ ID NOS: 115, 119 | SEQ ID NO.: 224 | SEQ ID NO.: 225 | VL-L2-VH SEQ ID NO. 228 |

TABLE 24-continued

Details of the bispecific CD137 (4-1BB, TNFRSF9)/Fibroblast Activation Protein (FAP) molecules of the invention

| | Name | CD137 (4-1BB, TNFRSF9) binding domain (VH/VL) | Fibroblast Activation Protein (FAP) binding domain (VH/VL) | (CD137 VH-Fc)-L1-(VL-L2-VH FAP-ScFV) | CD137 LC/FAB | FAP scFV orientation and sequence VL-L2-VH |
|---|---|---|---|---|---|---|
| 19 | CD137 #6 (B21.V37) + FAP #3 (A11 VK7/VH1) | SEQ ID NOS: 60, 65 (SEQ ID NO.: 595, 596 TABLE 16) | SEQ ID NOS: 124, 128 | SEQ ID NO.: 229 | SEQ ID NO.: 230 | VL-L2-VH SEQ ID NO. 233 |
| 20 | CD137 #8 (A49.V43) + FAP #5 (C3 VK1/VH4) | SEQ ID NOS: 80, 85 (SEQ ID NO.: 607, 608 TABLE 16) | SEQ ID NOS: 142, 146 | SEQ ID NO.: 234 | SEQ ID NO.: 230 | VL-L2-VH SEQ ID NO. 228 |
| 21 | CD137 # 8 (A49.V43) + FAP #2 (A11 VK3/VH3) | SEQ ID NOS: 80, 85 (SEQ ID NO.: 607, 608 TABLE 16) | SEQ ID NOS: 115, 119 | SEQ ID NO.: 239 | SEQ ID NO.: 240 | VL-L2-VH SEQ ID NO. 243 |
| 22 | CD137 #8 (A49.V43) + FAP #3 (A11 VK7/VH1) | SEQ ID NOS: 80, 85 (SEQ ID NO.: 607, 608 TABLE 16) | SEQ ID NOS: 124, 128 | SEQ ID NO.: 244 | SEQ ID NO.: 245 | VL-L2-VH SEQ ID NO. 248 |
| 23 | CD137 #9 (A49.V47) + FAP #5 (C3 VK1/VH4) | SEQ ID NOS: 90, 95 (SEQ ID NO.: 615, 616 TABLE 16) | SEQ ID NOS: 142, 146 | SEQ ID NO.: 249 | SEQ ID NO.: 250 | VL-L2-VH SEQ ID NO. 253 |
| 24 | CD137 #9 (A49.V47) + FAP #2 (A11 VK3/VH3) | SEQ ID NOS: 90, 95 SEQ ID NO.: 615, 616 TABLE 16) | SEQ ID NOS: 115, 119 | SEQ ID NO.: 254 | SEQ ID NO.: 255 | VL-L2-VH SEQ ID NO. 258 |
| 25 | CD137 #9 (A49.V47) + FAP #3 (A11 VK7/VH1) | SEQ ID NOS: 90, 95 SEQ ID NO.: 615, 616 TABLE 16) | SEQ ID NOS: 124, 128 | SEQ ID NO.: 259 | SEQ ID NO.: 260 | VL-L2-VH SEQ ID NO. 263 |
| 26 | CD137 #10 (A49.V48) + FAP #5 (C3 VK1/VH4) | SEQ ID NO.: 100, 105 SEQ ID NO.: 617, 618 TABLE 16) | SEQ ID NOS: 142, 146 | SEQ ID NO.: 264 | SEQ ID NO.: 265 | VL-L2-VH SEQ ID NO. 268 |
| 27 | CD137 #10 (A49.V48) + FAP #2 (A11 VK3/VH3) | SEQ ID NO.: 100, 105 SEQ ID NO.: 617, 618 TABLE 16) | SEQ ID NOS: 115, 119 | SEQ ID NO.: 269 | SEQ ID NO.: 270 | VL-L2-VH SEQ ID NO. 273 |
| 28 | CD137 #10 (A49.V48) + FAP #3 (A11 VK7/VH1) | SEQ ID NO.: 100, 105 SEQ ID NO.: 617, 618 TABLE 16) | SEQ ID NOS: 124, 128 | SEQ ID NO.: 274 | SEQ ID NO.: 275 | VL-L2-VH SEQ ID NO. 278 |

Example 7: In Vitro Assays—Biological Activity of the Targeted CD137-FAP Binding Molecules; FAP Dependent Cross-Linking of CD137 in Jurkat Cells A T cell fibroblast co-culture-assay was used to demonstrate T cell activation specific to FAP-mediated CD137-crosslinking. For this, internally generated FAP+HT1080 or FAP-HT1080 parental cells were added to cultures of Jurkat-CD137 NFκB luciferase cells (Promega #CS196004). Activation of the Jurkat-CD137 is measure through the NFκB-driven luciferase reporter. Cells were cultured in the presence of CD137/FAP molecules to identify FAP selective CD137 agonists. EC90/IC90 values are shown in Table 25 and Table 26.

TABLE 25

FAP-dependent activity of CD137 B21 and A49 clones as measured by cross-linking on HT1080-FAP expressing cells

| CD137/FAP Candidate | Total AUC [×10$^6$] | IC$_{90}$ | EC$_{90}$ |
|---|---|---|---|
| B21.V16 (CD137 #2)/FAP#5 | 3.6 | 74.3 | 0.87 |
| B21.V22 (CD137 #3)/FAP #3 | 1.9 | 143.8 | 2.41 |
| B21.V37 (CD137#6)/FAP #3 | 3.5 | 257.8 | 2.34 |
| B21.V16 (CD137 #2)/FAP #2 | 3.3 | 126.8 | 3.14 |
| B21.V25 (CD137 #4)/FAP #3 | 2.5 | 492.2 | 2.55 |
| B21.V29 (CD135 #5)/FAP #3 | 2.9 | 51.85 | 0.52 |
| B21.V25 (CD137 #4)/FAP #2 | 3.3 | 46.85 | 0.65 |
| B21.V29 (CD137 #5)/FAP #2 | 2.9 | 62.80 | 0.78 |
| B21.V22 (CD137 #3)/FAP #2 | 2.4 | 69.62 | 1.42 |
| B21.V25 (CD137 #4)/FAP #5 | 3.0 | 77.77 | 1.38 |
| B21.V22 (CD137 #3)/FAP #5 | 2.3 | 87.81 | 2.18 |
| B21.V37 (CD137 #6)/FAP #2 | 4.0 | 53.61 | 0.55 |
| B21.V29 (CD137#5)/FAP#5 | 3.2 | 35.70 | 0.80 |
| B21.V37 (CD137#6)/FAP#5 | 3.6 | 13.79 | 0.47 |
| A49.V48 (CD137#7)/FAP #3 | 12.6 | 86.7 | 1.91 |
| A49.V47 (CD137 #9)/FAP #3 | 9.5 | 1.07 | 1.65 |
| A49.V43 (CD137#8)/FAP #3 | 31.5 | 60.75 | 0.96 |
| A49.V48 (CD137 #7)/FAP #5 | 11.3 | 700.5 | 6.24 |
| A49.V48 (CD137 #7)/FAP #2 | 11.3 | 136.8 | 2.57 |
| A49.V47 (CD137 #9)/FAP #5 | 7.8 | 742.3 | 4.23 |
| A49.V47 (CD135#9)/FAP #2 | 7.6 | 93.84 | 3.01 |
| A49.V43 (CD137#8)/FAP #2 | 25.0 | 467.2 | 5.04 |
| A49.V43 (CD137#8)/FAP #5 | 31.8 | 54.01 | 0.98 |

The EC$_{50}$, IC$_{50}$, EC$_{90}$, and IC$_{90}$ as well as the ratio IC$_{50}$/EC$_{50}$, and IC$_{90}$/EC$_{90}$ of were calculated for representative clones and compared in Table 26. All clones showed relatively comparable behavior. Specifically the molecules displayed a bell-shaped response, which was unique to this assay. This response was consistent amongst molecules yielding IC$_{50}$/EC$_{50}$ and IC$_{90}$/EC$_{90}$ ratios that were statistically similar.

TABLE 26

CD137/FAP clones have comparable EC$_{50}$/IC$_{50}$ values

| CD137/FAP CANDIDATE | Average EC$_{50}$ [nM] | Average IC$_{50}$ [nM] | Ratio IC$_{50}$/EC$_{50}$ | Average EC$_{90}$ [nM] | Average IC$_{90}$ [nM] | Ratio IC$_{90}$/EC$_{90}$ |
|---|---|---|---|---|---|---|
| B21.V16 (#2)/FAP#5 | 0.233 | 538.333 | 2304.462 | 2.235 | 110.370 | 49.383 |
| B21.V16 (#2)/FAP#2 | 0.165 | 846.567 | 5131.433 | 1.470 | 87.810 | 59.741 |
| B21.V16 (#2)/FAP#3 | 0.082 | 361.200 | 4379.509 | 0.613 | 48.440 | 79.066 |
| B21.V22 (#4)/FAP#5 | 0.175 | 558.750 | 3187.393 | 1.249 | 98.635 | 78.971 |
| B21.V22 (#4)/FAP#2 | 0.273 | 888.500 | 3257.761 | 0.738 | 83.970 | 113.819 |
| B21.V22 (#4)/FAP#3 | 0.248 | 746.700 | 3014.534 | 1.514 | 79.215 | 52.335 |
| B21.V25 (#5)/FAP#5 | 0.115 | 319.350 | 2787.014 | 0.644 | 69.150 | 107.301 |
| B21.V25 (#5)/FAP#2 | 0.160 | 443.900 | 2779.587 | 0.883 | 86.650 | 98.092 |
| B21.V25 (#5)/FAP#3 | 0.090 | 347.250 | 3843.387 | 0.671 | 52.775 | 78.645 |
| B21.V25 (#6)/FAP#5 | 0.054 | 191.400 | 3518.059 | 0.315 | 13.790 | 43.847 |
| B21.V25 (#6)/FAP#2 | 0.153 | 314.050 | 2058.872 | 1.069 | 104.805 | 98.059 |
| B21.V25 (#6)/FAP#3 | 0.141 | 755.500 | 5372.253 | 1.425 | 164.530 | 115.447 |
| A49.V43 (#8)/FAP#5 | 0.166 | 624.500 | 3750.826 | 1.425 | 84.623 | 59.385 |
| A49.V43 (#8)/FAP#2 | 0.327 | 957.900 | 2928.164 | 2.591 | 210.477 | 81.244 |
| A49.V43 (#8)/FAP#3 | 0.170 | 361.500 | 2125.845 | 1.013 | 58.285 | 57.565 |
| Average all | 0.17 | 550.36 | 3362.87 | 1.19 | 90.24 | 78.19 |
| SEM (±) | 0.02 | 62.36 | 257.93 | 0.29 | 0.16 | 0.16 |

Using the luciferase reporter assay system, inventors confirmed that CD137/FAP bi-specific molecules of the invention only activate Jurkat-CD137 cells in the presence of FAP-positive cells but not in the presence of FAP negative cells. The data shows that the set of CD137 variant molecules show diverse levels of activity, but also that all CD137 engagement and therefore activity was limited to occur only in presence of FAP expressing cells (FIG. 13A-D).

Example 8: Effect of the Bispecific CD137 (4-1BB, TNFRSF9)/Fibroblast Activation Protein (FAP) Molecules on T Cell-Activation The CD137/FAP molecules of the invention are highly specific and potent molecules that activate T-cells through the CD137 receptor in a FAP-dependent manner. To evaluate the ability CD137/FAP molecules of the invention to engage and activate primary human T cells a human PBMC activation assay measuring IFN-γ secretion was used. This assay was performed using CD137/FAP molecules selected from the Jurkat NFκB screening assay as described in Example 7 above.

To demonstrate activation and simulate a tumor microenvironment, anti-CD3 (clone OKT3) was coated on plates at a concentration of 0.5 μg/ml. Next, mitomycin C treated HT1080-FAP positive cells were added with human PBMCs. T cell activation was measured after 24 hours by quantitating hIFN-γ levels by MSD analysis (Meso Scale Discovery). EC$_{50}$ values for each clone are shown in FIG. 14A-14H. Stimulation with CD3 alone results in IFN-γ secretion however, PBMCs co-cultured with FAP positive HT1080 cells in the presence of CD137/FAP molecules secreted upwards of 50% more IFN-γ than the level of CD3 alone. This increase in IFN-γ can be attributed to the costimulation activity provided by the CD137FAP molecules.

Additionally, primary human PBMCs from eight healthy donors also showed FAP-dependent IFN-γ production when cultured with increasing levels CD137/FAP bispecific molecules of the invention in the presence of HT1080-FAP+ve fibrosarcoma cells.

FIGS. 15A and 15B shows hIFN-γ secretion of the individual donor PBMCs with increasing concentrations of an exemplary CD137 B21/FAP molecule (FIG. 15B). This exemplar displayed ideal properties for this series of molecules which was a potent IFN-γ response consistent across multiple donor PBMCs in the presence of FAP-expressing cells. Additionally, this response was lost in the absence of FAP-expressing cells.

Example 9: In Vitro FAP Enzymatic Activity is not Inhibited by CD137/FAP Binding FAP is a surface localized glycoprotein with endopeptidase activity. Although FAP expression is low in most tissues, it is upregulated in activated fibroblasts at sites of active tissue remodeling and in cancer. Several substrates are reported to be cleaved by FAP however the physiological importance of this activity is not well understood. To this end, a FAP enzymatic assay was used to determine if the FAP targeted antibodies of the invention interferes with FAP enzymatic activity.

To demonstrate this, a fluorogenic FAP activity assay (BPS Bioscience #80210) was used. This assay was performed using Talabostat mesylate as a positive control for FAP inhibition, where inhibition is concentration dependent (FIG. 16B). FIG. 16A demonstrates that the exemplary molecules of the invention, CD137-B21/FAP-C3 and murine CD137 B21/FAP-A11, do not interfere with the enzymatic activity of the FAP protein, and thus appears not to interfere with the physiological activity of FAP.

Example 10: In Vivo Efficacy of Bispecific Molecules in CRC Xenograft Models

The inventors also investigated the in vivo efficacy of binding molecules recognizing CD137 (4-1BB, TNFRSF9) and Fibroblast Activation Protein (FAP). For this purpose, a human tumor model was developed.

Efficacy studies were performed in a subcutaneous syngeneic MC38 colorectal cancer model in CD137 KI HuGEMM™ Mice. In this model, the tumor cells as well as the tumor stroma cells are of mouse origin, the T-cells are also of mouse origin but express the human CD137 antigen on the cell surface. In brief, the MC38 mouse tumor cells were inoculated subcutaneously in the right rear flank region with approximately 1×10 6 tumor cells/mouse for tumor development. Treatment was started on day 7 when tumors had a median volume of 63.6 mm3, the murine cross-reactive CD137/FAP, the mouse optimized surrogate molecule (VH and VL, SEQ ID NOs:169, 170, respectively) or vehicle buffer (50 mM NaOAc, 100 mM NaCl, pH 5.0) was administered in a q7d dosing regimen by intraperitoneal injections (i.p.), the mouse PD-1 antibody (murine PD-1 antibody originates from clone RMP1-14, as described in Chen, S., Lee, L-F., Fisher, T. S, et al., February 2015, DOI: 10.1158/2326-6066.CIR-14-0118, and herein incorporated by reference) was administered twice a week i.p.

Tumor growth was monitored by external caliper measurements and tumor volumes were calculated using a standard hemiellipsoid formula. Animals reaching humane end point were euthanized early during the studies for ethical reasons. Endpoint tumors were collected for IHC analysis—inventors found increased infiltration of CD8+ T cells into the tumor as compared to vehicle alone.

The schematic presented in FIG. 17 represents the dosing schedule of the molecules in the subcutaneous syngeneic MC38 colorectal cancer model in CD137 KI HuGEMM™ mice.

In a first in vivo study, mice were treated with either optimized human CD137-B21/FAP-C3 or murine CD137 B21/FAP-A11 molecules administered i.p. at a dose of 10 mg/kg in a q7d regimen. Both molecules showed weak tumor activity with a TGI of 43% and 46% at day 22 respectively (FIG. 18B).

FIG. 18A-D demonstrates the in vivo efficacy of human CD137 B21/FAP C3 and murine CD137 B21/FAP-A11 montherapy in subcutaneous syngeneic MC38 colorectal cancer model in CD137 KI HuGEMM mice. FIG. 18A shows the average tumor growth curve post treatment with human CD137 B21/FAP C3 and FIG. 18B shows the individual tumor growth curve post treatment with human CD137 B21/FAP C3. Likewise, FIG. 18C shows the average tumor growth curve post treatment with murine CD137 B21/FAP A11 and FIG. 18D shows the Individual tumor growth curve post treatment with murine CD137 B21/FAP A11.

The data presented in FIG. 18A-D demonstrates that binding molecules of the invention are able to induce reductions of the tumor volume when compared with the control group and the effect is dose dependent.

The data presented in FIGS. 19A and 19B demonstrates that human CD137 B21/FAP C3 and murine CD137 B21/FAP-A11 binding molecules of the invention are able to induce increases of CD3+ or CD8+ T cell infiltrates into the tumor microenvironment when compared with the control group.

Example 11: Synergistic Effects with PD-1 Ab and CD137/FAP

Inventors investigated the potential of a combination of CD137/FAP administered at 10 mg/kg in a q7d regimen with a mouse PD-1 antibody (murine PD-1 antibody originates from clone RMP1-14, as described in Chen, S., Lee, L-F., Fisher, T. S, et al., February 2015, DOI: 10.1158/2326-6066.CIR-14-0118, and herein incorporated by reference) at 10 mg/kg in a q3d/q4d regimen.

In this study, the treatment with murine CD137 B21/FAP A11 as monotherapy led to a similar tumor activity with a TGI of 44%. However, in this example, human CD137 B21/FAP A11 did not show tumor activity as a monotherapy, which could be explained by the typical variation of biological models in combination with the approximately 130-fold weaker affinity to human FAP compared to murine CD137 B21/FAP A11.

The data presented in FIGS. 20B-E demonstrates that binding molecules of the invention are able to induce reductions of the tumor volume in combination with a PD-1 antagonist mAb when compared with the control group and the effect is dose dependent.

The combination therapy with the mouse PD-1 antibody and human CD137 B21/FAP A11 (FIGS. 20B and 20D) or murine CD137 B21/FAP A11 (FIGS. 20C and 20E) led to a strong and statistically significant ($p<0.0001$) increase of tumor activity with a TGI of 92% and 94% on day 24 respectively suggesting a synergistic effect of the combination of human CD137 B21/FAP A11 and anti PD-1.

The combination therapy with the mouse PD-1 antibody and human CD137 B21/FAP A11 or murine CD137 B21/FAP A11 also led to a significant number of tumor regressions (defined as tumor volume less than 100 mm$^3$) with 50% and 37.5%, respectively, suggesting a synergistic effect of the combination of CD137/FAP molecules and anti-PD-1 (Table 27). The effect is dose dependent with a loss of tumor regression at 1 mpk of murine CD137 B21/FAP A11 (Table 27).

TABLE 27

Tumor regression and growth inhibition

| Treatment | Regressions[1] | TGI |
| --- | --- | --- |
| Vehicle | 0/8 | 0% |
| anti-mouse PD-1 10 mpk | 0/8 | 58% |
| huCD137 B21/FAP A11 10 mpk | 0/8 | −6% |
| muCD137 B21/FAP A11 10 mpk | 0/8 | 43% |
| PD-1 + huCD137 B21/FAP A11 10 mpk | 4/8 | 88% |
| PD-1 + muCD137 B21/FAP A11 10 mpk | 3/8 | 91% |
| PD-1 + muCD137 B21/FAP A11 3 mpk | 3/8 | 77% |
| PD-1 + muCD137 B21/FAP A11 1 mpk | 0/8 | 78% |

[1]defined as tumor volume less than 100 mm$^3$

The data presented in Table 27 demonstrates that binding molecules of the invention are able to induce tumor regressions when combined with a PD-1 agonist as compared to the control groups and that the effect is dose dependent.

The combination therapy with the mouse PD-1 antibody and human CD137 B21/FAP A11 led to a strong and statistically significant reduction in tumor viable area and increase in both CD4+ and CD8+ T cell tumor infiltrates suggesting a synergistic effect of the combination of human CD137 B21/FAP A11 and anti-PD-1 (FIG. 21A-G). This increase in CD8+ infiltration (FIG. 21C) was positively correlated with the reduction in tumor viable area (FIG. 21G).

The data presented in FIG. 21A-G demonstrates that binding molecules of the invention are able to induce both CD4 and CD8 T cell infiltration when combined with a PD-1 agonist as compared with the control groups. The data also demonstrates that the increase in CD8+ T cell infiltration is positive correlated with loss of tumor viable area.

SEQUENCE LISTING (704 sequences)

SEQ ID NO: 1 - protein, 162 aa, Homo sapiens
LQDPCSNCPAGTFCDNNRNQICSPCPPNSFSSAGGQRTCDICRQCKGVFRTRKECSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQ

SEQ ID NO: 2 - protein, 163 aa, Macaca mulatta
LQDLCSNCPAGTFCDNNRSQICSPCPPNSFSSAGGQRTCDICRQCKGVFKTRKECSSTSNAECDCISGYHCLGAECSMCEQDCKQGQELTKKGCKDCCFGTFNDQKRGICRPWTNCSLDGKSVLVNGTKERDVVCGPSPADLSPGASSATPPAPAREPGHSPQ

SEQ ID NO: 3 - protein, 164 aa, Mus musculus
VQNSCDNCQPGTFCRKYNPVCKSCPPSTFSSIGGQPNCNICRVCAGYFRFKKFCSSTHNAECECIEGFHCLGPQCTRCEKDCRPGQELTKQGCKTCSLGTFNDQNGTGVCRPWTNCSLDGRSVLKTGTTEKDVVCGPPVVSFSPSTTISVTPEGGPGGHSLQVL

SEQ ID NO: 4 - protein, 760 aa, Homo sapiens
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 5 - protein, 756 aa, Mus musculus
MKTWLKTVFGVTTLAALALVVICIVLRPSRGNTKRALTLKDILNGTFSYKTYFPNWISEQEYLHQSEDDNIVFYNIETRESYIILSNSTMKSVNATDYGLSPDRQFVYLESDYSKLWRYSYTATYYIYDLQNGEFVRGYELPRPIQYLCWSPVGSKLAYVYQNNIYLKQRPGDPPFQITYTGRENRIFNGIPDWVYEEEMLATKYALWWSPDGKFLAYVEFNDSDIPIIAYSYYGDGQYPRTINIPYPKAGAKNPVVRVFIVDTTYPHHVGPMEVPVPEMIASSDYYFSWLTWVSSERVCLQWLKRVQNVSVLSICDFREDWHAWECPKNQEHVEESRTGWAGGFFVSTPAFSQDATSYYKIFSDKDGYKHIHYIKDTVENAIQITSGKWEAIYIFRVTQDSLFYSSNEFEGYPGRRNIYRISIGNSPPSKKCVTCHLRKERCQYYTASFSYKAKYYALVCYGPGLPISTLHDGRTDQEIQVLEENKELENSLRNIQLPKVEIKKLKDGGLTFWYKMILPPQFDRSKKYPLLIQVYGGPCSQSVKSVFAVNWITYLASKEGIVIALVDGRGTAFQGDKFLHAVYRKLGVYEVEDQLTAVRKFIEMGFIDEERIAIWGWSYGGYVSSLALASGTGLFKCGIAVAPVSSWEYYASIYSERFMGLPTKDDNLEHYKNSTVMARAEYFRNVDYLLIHGTADDNVHFQNSAQIAKALVNAQVDFQAMWYSDQNHGISSGRSQNHLYTHMTHFLKQCFSLSD

SEQ ID NO: 6 - protein, 448 aa, Artificial Sequence
  Description of Artificial Sequence: Synthetic polypeptide
EVKLVESEGGLVQPGSSMKLSCTASGFTFSDFYMAWVRQVPEKGLEWVANINYDGSSTYYLDSLKSRFIISRDNARNILYLQMSSLKSEDTATYYCAREGDEGWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 7 - protein, 10 aa, Artificial Sequence
  Description of Artificial Sequence: Synthetic peptide
GFTFSDFYMA

SEQ ID NO: 8 - protein, 17 aa, Artificial Sequence
  Description of Artificial Sequence: Synthetic peptide
NINYDGSSTYYLDSLKS

SEQ ID NO: 9 - protein, 10 aa, Artificial Sequence
  Description of Artificial Sequence: Synthetic peptide
EGDEGWYFDV

SEQ ID NO: 10 - protein, 119 aa, Artificial Sequence
  Description of Artificial Sequence: Synthetic polypeptide
EVKLVESEGGLVQPGSSMKLSCTASGFTFSDFYMAWVRQVPEKGLEWVANINYDGSSTYYLDSLKSRFIISRDNARNILYLQMSSLKSEDTATYYCAREGDEGWYFDVWGAGTTVTVSS

SEQ ID NO: 11 - protein, 214 aa, Artificial Sequence
  Description of Artificial Sequence: Synthetic polypeptide
DIVMTQSHKFMSTSVGDRVSITCKASQDVSTAVAWYQQKPGQSPKLLIYSASYRYTGVPDRFTGSGSGTDFTFTISSVQAEDLAVYYCQQHYSNPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12 - protein, 11 aa, Artificial Sequence
  Description of Artificial Sequence: Synthetic peptide
KASQDVSTAVA

SEQ ID NO: 13 - protein, 7 aa, Artificial Sequence
  Description of Artificial Sequence: Synthetic peptide
SASYRYT

SEQ ID NO: 14 - protein, 9 aa, Artificial Sequence
  Description of Artificial Sequence: Synthetic peptide
QQHYSNPWT

SEQ ID NO: 15 - protein, 107 aa, Artificial Sequence
  Description of Artificial Sequence: Synthetic polypeptide
DIVMTQSHKFMSTSVGDRVSITCKASQDVSTAVAWYQQKPGQSPKLLIYSASYRYTGVPDRFTGSGSGTDFTFTISSVQAEDLAVYYCQQHYSNPWTFGGGTKLEIK

SEQ ID NO: 16 - protein, 448 aa, Artificial Sequence
  Description of Artificial Sequence: Synthetic polypeptide
EVQLVESGGGLVQPGGSLRLSCAASGFTFSDFYMSWVRQAPGKGLEWVANINYEGSSKYYVESVKGRFTISRDNAKNILYLQMNSLRAEDTAVYYCAREGDEGWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 17 - protein, 10 aa, Artificial Sequence
  Description of Artificial Sequence: Synthetic peptide
GFTFSDFYMS

SEQ ID NO: 18 - protein, 17 aa, Artificial Sequence
  Description of Artificial Sequence: Synthetic peptide
NINYEGSSKYYVESVKG

SEQ ID NO: 19 - protein, 10 aa, Artificial Sequence
  Description of Artificial Sequence: Synthetic peptide
EGDEGWYFDV

SEQ ID NO: 20 - protein, 119 aa, Artificial Sequence
  Description of Artificial Sequence: Synthetic polypeptide
EVQLVESGGGLVQPGGSLRLSCAASGFTFSDFYMSWVRQAPGKGLEWVANINYEGSSKYYVESVKGRFTISRDNAKNILYLQMNSLRAEDTAVYYCAREGDEGWYFDVWGQGTTVTVSS

SEQ ID NO: 21 - protein, 214 aa, Artificial Sequence
  Description of Artificial Sequence: Synthetic polypeptide
DIQMTQSPSSLSASVGDRVTITCKASQDISSAVAWYQQKPGKAPKLLIYSASSRYTGVPSRFSGSGSGTDFTLTISSLQPEDFAVYYCQQHYSNPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22 - protein, 11 aa, Artificial Sequence
  Description of Artificial Sequence: Synthetic peptide
KASQDISSAVA

SEQ ID NO: 23 - protein, 7 aa, Artificial Sequence
  Description of Artificial Sequence: Synthetic peptide
SASSRYT

SEQ ID NO: 24 - protein, 9 aa, Artificial Sequence
  Description of Artificial Sequence: Synthetic peptide
QQHYSNPWT

SEQ ID NO: 25 - protein, 107 aa, Artificial Sequence
  Description of Artificial Sequence: Synthetic polypeptide
DIQMTQSPSSLSASVGDRVTITCKASQDISSAVAWYQQKPGKAPKLLIYSASSRYTGVPSRFSGSGSGTDFTLTISSLQPEDFAVYYCQQHYSNPWTFGQGTKLEIK

SEQ ID NO: 26 - protein, 448 aa, Artificial Sequence
  Description of Artificial Sequence: Synthetic polypeptide
EVQLVESGGGLVQPGGSLRLSCAASGFTFSDFYMSWVRQAPGKGLEWVANINYEASSKYYVDSLKGRFTISRDNAKNILYLQMNSLRAEDTAVYYCAREGDEGWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 27 - protein, 10 aa, Artificial Sequence
  Description of Artificial Sequence: Synthetic peptide
GFTFSDFYMS

SEQ ID NO: 28 - protein, 17 aa, Artificial Sequence
  Description of Artificial Sequence: Synthetic peptide
NINYEASSKYYVDSLKG

SEQ ID NO: 29 - protein, 10 aa, Artificial Sequence
  Description of Artificial Sequence: Synthetic peptide
EGDEGWYFDV

SEQ ID NO: 30 - protein, 119 aa, Artificial Sequence
  Description of Artificial Sequence: Synthetic polypeptide
EVQLVESGGGLVQPGGSLRLSCAASGFTFSDFYMSWVRQAPGKGLEWVANINYEASSKYYVDSLKGRFTISRDNAKNILYLQMNSLRAEDTAVYYCAREGDEGWYFDVWGQGTTVTVSS

SEQ ID NO: 31 - protein, 214 aa, Artificial Sequence
  Description of Artificial Sequence: Synthetic polypeptide
DIQMTQSPSSLSASVGDRVTITCRASQSVSSALAWYQQKPGKAPKLLIYAASYRQSGVPSRFSGSGSGTDFTLTISSLQPEDFAVYYCQQHYSNPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32 - protein, 11 aa, Artificial Sequence
  Description of Artificial Sequence: Synthetic peptide
RASQSVSSALA

SEQ ID NO: 33 - protein, 7 aa, Artificial Sequence
  Description of Artificial Sequence: Synthetic peptide
AASYRQS

SEQ ID NO: 34 - protein, 9 aa, Artificial Sequence
  Description of Artificial Sequence: Synthetic peptide
QQHYSNPWT

SEQ ID NO: 35 - protein, 107 aa, Artificial Sequence
  Description of Artificial Sequence: Synthetic polypeptide
DIQMTQSPSSLSASVGDRVTITCRASQSVSSALAWYQQKPGKAPKLLIYAASYRQSGVPSRFSGSGSGTDFTLTISSLQPEDFAVYYCQQHYSNPWTFGQGTKLEIK

SEQ ID NO: 36 - protein, 448 aa, Artificial Sequence
  Description of Artificial Sequence: Synthetic polypeptide
EVQLVESGGGLVQPGGSLRLSCAASGFTFSDFYMSWVRQAPGKGLEWVANIQYEGSSKYYVESLKGRFTISRDNAKNILYLQMNSLRAEDTAVYYCAREGDEGWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 37 - protein, 10 aa, Artificial Sequence
  Description of Artificial Sequence: Synthetic peptide
GFTFSDFYMS

SEQ ID NO: 38 - protein, 17 aa, Artificial Sequence
  Description of Artificial Sequence: Synthetic peptide
NIQYEGSSKYYVESLKG

SEQ ID NO: 39 - protein, 10 aa, Artificial Sequence
  Description of Artificial Sequence: Synthetic peptide
EGDEGWYFDV

SEQ ID NO: 40 - protein, 119 aa, Artificial Sequence
  Description of Artificial Sequence: Synthetic polypeptide
EVQLVESGGGLVQPGGSLRLSCAASGFTFSDFYMSWVRQAPGKGLEWVANIQYEGSSKYYVESLKGRFTISRDNAKNILYLQMNSLRAEDTAVYYCAREGDEGWYFDVWGQGTTVTVSS

SEQ ID NO: 41 - protein, 214 aa, Artificial Sequence
  Description of Artificial Sequence: Synthetic polypeptide
DIQMTQSPSSLSASVGDRVTITCRASQSISTAVAWYQQKPGKAPKLLIYAASYLYSGVPSRFSGSGSGTDFTLTISSLQPEDFAVYYCQQHYSNPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42 - protein, 11 aa, Artificial Sequence
  Description of Artificial Sequence: Synthetic peptide
RASQSISTAVA

SEQ ID NO: 43 - protein, 7 aa, Artificial Sequence
  Description of Artificial Sequence: Synthetic peptide
AASYLYS

SEQ ID NO: 44 - protein, 9 aa, Artificial Sequence
  Description of Artificial Sequence: Synthetic peptide
QQHYSNPWT

SEQ ID NO: 45 - protein, 107 aa, Artificial Sequence
  Description of Artificial Sequence: Synthetic polypeptide
DIQMTQSPSSLSASVGDRVTITCRASQSISTAVAWYQQKPGKAPKLLIYAASYLYSGVPSRFSGSGSGTDFTLTISSLQPEDFAVYYCQQHYSNPWTFGQGTKLEIK

SEQ ID NO: 46 - protein, 448 aa, Artificial Sequence; identical to SEQ ID NO: 36
  Description of Artificial Sequence: Synthetic polypeptide

SEQ ID NO: 47 - protein, 10 aa, Artificial Sequence
  Description of Artificial Sequence: Synthetic peptide
GFTFSDFYMS

SEQ ID NO: 48 - protein, 17 aa, Artificial Sequence
  Description of Artificial Sequence: Synthetic peptide
NIQYEGSSKYYVESLKG

SEQ ID NO: 49 - protein, 10 aa, Artificial Sequence
  Description of Artificial Sequence: Synthetic peptide
EGDEGWYFDV

SEQ ID NO: 50 - protein, 119 aa, Artificial Sequence; identical to SEQ ID NO: 40
  Description of Artificial Sequence: Synthetic polypeptide

SEQ ID NO: 51 - protein, 214 aa, Artificial Sequence
  Description of Artificial Sequence: Synthetic polypeptide
DIQMTQSPSSLSASVGDRVTITCRASQSISTALAWYQQKPGKAPKLLIYAASYRYSGVPSRFSGSGSGTDFTLTISSLQPEDFAVYYCQQHYSNPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 52 - protein, 11 aa, Artificial Sequence
  Description of Artificial Sequence: Synthetic peptide
RASQSISTALA

SEQ ID NO: 53 - protein, 7 aa, Artificial Sequence
  Description of Artificial Sequence: Synthetic peptide
AASYRYS

SEQ ID NO: 54 - protein, 9 aa, Artificial Sequence
  Description of Artificial Sequence: Synthetic peptide
QQHYSNPWT

SEQ ID NO: 55 - protein, 107 aa, Artificial Sequence
  Description of Artificial Sequence: Synthetic polypeptide
DIQMTQSPSSLSASVGDRVTITCRASQSISTALAWYQQKPGKAPKLLIYAASYRYSGVPSRFSGSGSGTDFTLTISSLQPEDFAVYYCQQHYSNPWTFGQGTKLEIK

SEQ ID NO: 56 - protein, 448 aa, Artificial Sequence; identical to SEQ ID NO: 16
  Description of Artificial Sequence: Synthetic polypeptide

SEQ ID NO: 57 - protein, 10 aa, Artificial Sequence
  Description of Artificial Sequence: Synthetic peptide
GFTFSDFYMS

SEQ ID NO: 58 - protein, 17 aa, Artificial Sequence
  Description of Artificial Sequence: Synthetic peptide
NINYEGSSKYYVESVKG

SEQ ID NO: 59 - protein, 10 aa, Artificial Sequence
  Description of Artificial Sequence: Synthetic peptide
EGDEGWYFDV

SEQ ID NO: 60 - protein, 119 aa, Artificial Sequence; identical to SEQ ID NO: 20
  Description of Artificial Sequence: Synthetic polypeptide

SEQ ID NO: 61 - protein, 214 aa, Artificial Sequence; identical to SEQ ID NO: 51
  Description of Artificial Sequence: Synthetic polypeptide

SEQ ID NO: 62 - protein, 11 aa, Artificial Sequence
  Description of Artificial Sequence: Synthetic peptide
RASQSISTALA

SEQ ID NO: 63 - protein, 7 aa, Artificial Sequence
  Description of Artificial Sequence: Synthetic peptide
AASYRYS

SEQ ID NO: 64 - protein, 9 aa, Artificial Sequence
  Description of Artificial Sequence: Synthetic peptide
QQHYSNPWT

SEQ ID NO: 65 - protein, 107 aa, Artificial Sequence; identical to SEQ ID NO: 55
  Description of Artificial Sequence: Synthetic polypeptide

SEQ ID NO: 66 - protein, 447 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARDQSGGGSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 67 - protein, 10 aa, Artificial Sequence
  Description of Artificial Sequence: Synthetic peptide
GGSISSYYWS

SEQ ID NO: 68 - protein, 16 aa, Artificial Sequence
  Description of Artificial Sequence: Synthetic peptide
YIYYSGSTNYNPSLKS

SEQ ID NO: 69 - protein, 10 aa, Artificial Sequence
  Description of Artificial Sequence: Synthetic peptide
DQSGGGSFQH

SEQ ID NO: 70 - protein, 118 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARDQSGGGSFQHWGQGTLVTVSS

SEQ ID NO: 71 - protein, 219 aa, Artificial Sequence
  Description of Artificial Sequence: Synthetic polypeptide
EIVMTQSPLSLPVTPGEPASISCRSSQSLLYSNGYNHLDWYLQKPGQSPQLLIYLGSNRASGVPDRFSGSGSGTDFTLKISRVEAEDVGVYYCMQALQTPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 72 - protein, 16 aa, Artificial Sequence
  Description of Artificial Sequence: Synthetic peptide
RSSQSLLYSNGYNHLD

SEQ ID NO: 73 - protein, 7 aa, Artificial Sequence
  Description of Artificial Sequence: Synthetic peptide
LGSNRAS

SEQ ID NO: 74 - protein, 9 aa, Artificial Sequence
  Description of Artificial Sequence: Synthetic peptide
MQALQTPPT

SEQ ID NO: 75 - protein, 112 aa, Artificial Sequence
  Description of Artificial Sequence: Synthetic polypeptide
EIVMTQSPLSLPVTPGEPASISCRSSQSLLYSNGYNHLDWYLQKPGQSPQLLIYLGSNRASGVPDRFSGSGSGTDFTLKISRVEAEDVGVYYCMQALQTPPTFGQGTKLEIK

SEQ ID NO: 76 - protein, 445 aa, Artificial Sequence
  Description of Artificial Sequence: Synthetic polypeptide
QVQLQESGPGLVKPSETLSLTCTVSGGSISSYYWSWIRQPPGKGLEWMGYIYYSGSTNINPSLKSRVTISVDTSKNQFSLKLSSVTAADTAVYYCARDQSGGGSFQHWGQGTLVTVSSASTKGPSVFPLAPSSKSTSGGTAGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 77 - protein, 10 aa, Artificial Sequence
  Description of Artificial Sequence: Synthetic peptide
GGSISSYYWS

SEQ ID NO: 78 - protein, 16 aa, Artificial Sequence
  Description of Artificial Sequence: Synthetic peptide
YIYYSGSTNINPSLKS

SEQ ID NO: 79 - protein, 10 aa, Artificial Sequence
  Description of Artificial Sequence: Synthetic peptide
DQSGGGSFQH

SEQ ID NO: 80 - protein, 118 aa, Artificial Sequence
  Description of Artificial Sequence: Synthetic polypeptide
QVQLQESGPGLVKPSETLSLTCTVSGGSISSYYWSWIRQPPGKGLEWMGYIYYSGSTNINPSLKSRVTISVDTSKNQFSLKLSSVTAADTAVYYCARDQSGGGSFQHWGQGTLVTVSS

SEQ ID NO: 81 - protein, 219 aa, Artificial Sequence; identical to SEQ ID NO: 71
  Description of Artificial Sequence: Synthetic polypeptide

SEQ ID NO: 82 - protein, 16 aa, Artificial Sequence
  Description of Artificial Sequence: Synthetic peptide
RSSQSLLYSNGYNHLD

SEQ ID NO: 83 - protein, 7 aa, Artificial Sequence
  Description of Artificial Sequence: Synthetic peptide
LGSNRAS

SEQ ID NO: 84 - protein, 9 aa, Artificial Sequence
  Description of Artificial Sequence: Synthetic peptide
MQALQTPPT

SEQ ID NO: 85 - protein, 112 aa, Artificial Sequence; identical to SEQ ID NO: 75
  Description of Artificial Sequence: Synthetic polypeptide

SEQ ID NO: 86 - protein, 447 aa, Artificial Sequence
  Description of Artificial Sequence: Synthetic polypeptide
QVQLQESGPGLVKPSETLSLTCTVSGGSISSYYWSWIRQPPGKGLEWMGYIYYSGSTNINPSLKSRVTISVDTSKNQFSLKLSSVTAADTAVYYCARDQSGGGSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 87 - protein, 10 aa, Artificial Sequence
  Description of Artificial Sequence: Synthetic peptide
GGSISSYYWS

SEQ ID NO: 88 - protein, 16 aa, Artificial Sequence
  Description of Artificial Sequence: Synthetic peptide
YIYYSGSTNINPSLKS

SEQ ID NO: 89 - protein, 10 aa, Artificial Sequence
  Description of Artificial Sequence: Synthetic peptide
DQSGGGSFQH

SEQ ID NO: 90 - protein, 118 aa, Artificial Sequence; identical to SEQ ID NO: 80
  Description of Artificial Sequence: Synthetic polypeptide

SEQ ID NO: 91 - protein, 219 aa, Artificial Sequence
  Description of Artificial Sequence: Synthetic polypeptide
EIVMTQSPLSLPVTPGEPASISCRSSQSLLYSQGYNHLDWYLQKPGQSPQLLIYGGSNRASGVPDRFSGSGSGTDFTLKISRVEAEDVGVYYCMQALQTPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 92 - protein, 16 aa, Artificial Sequence
  Description of Artificial Sequence: Synthetic peptide
RSSQSLLYSQGYNHLD

SEQ ID NO: 93 - protein, 7 aa, Artificial Sequence
  Description of Artificial Sequence: Synthetic peptide
GGSNRAS

SEQ ID NO: 94 - protein, 9 aa, Artificial Sequence
  Description of Artificial Sequence: Synthetic peptide
MQALQTPPT

SEQ ID NO: 95 - protein, 112 aa, Artificial Sequence
  Description of Artificial Sequence: Synthetic polypeptide
EIVMTQSPLSLPVTPGEPASISCRSSQSLLYSQGYNHLDWYLQKPGQSPQLLIYGGSNRASGVPDRFSGSGSGTDFTLKISRVEAEDVGVYYCMQALQTPPTFGQGTKLEIK

SEQ ID NO: 96 - protein, 447 aa, Artificial Sequence
  Description of Artificial Sequence: Synthetic polypeptide
QVQLQESGPGLVKPSETLSLTCTVSGGSISSYYWSWIRQPPGKGLEWMGYIYYSGSTQYNPSLKSRVTISVDTSKNQFSLKLSSVTAADTAVYYCARDQSGGGSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 97 - protein, 10 aa, Artificial Sequence
  Description of Artificial Sequence: Synthetic peptide
GGSISSYYWS

SEQ ID NO: 98 - protein, 16 aa, Artificial Sequence
  Description of Artificial Sequence: Synthetic peptide
YIYYSGSTQYNPSLKS

SEQ ID NO: 99 - protein, 10 aa, Artificial Sequence
  Description of Artificial Sequence: Synthetic peptide
DQSGGGSFQH

SEQ ID NO: 100 - protein, 118 aa, Artificial Sequence
  Description of Artificial Sequence: Synthetic polypeptide
QVQLQESGPGLVKPSETLSLTCTVSGGSISSYYWSWIRQPPGKGLEWMGYIYYSGSTQYNPSLKSRVTISVDTSKNQFSLKLSSVTAADTAVYYCARDQSGGGSFQHWGQGTLVTVSS

SEQ ID NO: 101 - protein, 219 aa, Artificial Sequence; identical to SEQ ID NO: 91
  Description of Artificial Sequence: Synthetic polypeptide

SEQ ID NO: 102 - protein, 16 aa, Artificial Sequence
  Description of Artificial Sequence: Synthetic peptide
RSSQSLLYSQGYNHLD

SEQ ID NO: 103 - protein, 7 aa, Artificial Sequence
  Description of Artificial Sequence: Synthetic peptide
GGSNRAS

SEQ ID NO: 104 - protein, 9 aa, Artificial Sequence
  Description of Artificial Sequence: Synthetic peptide
MQALQTPPT

SEQ ID NO: 105 - protein, 112 aa, Artificial Sequence; identical to SEQ ID NO: 95
  Description of Artificial Sequence: Synthetic polypeptide

SEQ ID NO: 106 - protein, 117 aa, Artificial Sequence
  Description of Artificial Sequence: Synthetic polypeptide
DVQLVESGGGLVQPGGSLRLSCAASGFSMSNFAMTWVRQAPGEGLEWVSGIRGSGTTYYADSVKGRFTVSRDNSKNTLYLQMNSLRAEDTAIYYCAKTWGTEYFDYWGLGTLVTVSS

SEQ ID NO: 107 - protein, 10 aa, Artificial Sequence
  Description of Artificial Sequence: Synthetic peptide
GFSMSNFAMT

SEQ ID NO: 108 - protein, 16 aa, Artificial Sequence
  Description of Artificial Sequence: Synthetic peptide
GIRGSGTTYYADSVKG

SEQ ID NO: 109 - protein, 9 aa, Artificial Sequence
  Description of Artificial Sequence: Synthetic peptide
TWGTEYFDY

SEQ ID NO: 110 - protein, 108 aa, Artificial Sequence
  Description of Artificial Sequence: Synthetic polypeptide
EIVLTQSPGTLSLSPGERATLSCRASQPINNYLAWYQQKPGQAPRLLIFSASNRATGIPDRFSGSGSGTEFTLTISSLEPEDFAVYYCQQYYDWPPYTFGGGTKVEIK

SEQ ID NO: 111 - protein, 11 aa, Artificial Sequence
  Description of Artificial Sequence: Synthetic peptide
RASQPINNYLA

SEQ ID NO: 112 - protein, 7 aa, Artificial Sequence
  Description of Artificial Sequence: Synthetic peptide
SASNRAT

SEQ ID NO: 113 - protein, 10 aa, Artificial Sequence
  Description of Artificial Sequence: Synthetic peptide
QQYYDWPPYT

SEQ ID NO: 114 - protein, 245 aa, Artificial Sequence
  Description of Artificial Sequence: Synthetic polypeptide
EIVLTQSPGTLSLSPGERATLSCRASQPINNYLAWYQQKPGQAPRLLIFSASNRATGIPDRFSGSGSGTEFTLTISSLEPEDFAVYYCQQYYDWPPYTFGGGTKVEIKGGGGSGGGGSGGGGSGGGGSDVQLVESGGGLVQPGGSLRLSCAASGFSMSNFAMTWVRQAPGEGLEWVSGIRGSGTTYYADSVKGRFTVSRDNSKNTLYLQMNSLRAEDTAIYYCAKTWGTEYFDYWGLGTLVTVSS

SEQ ID NO: 115 - protein, 117 aa, Artificial Sequence
  Description of Artificial Sequence: Synthetic polypeptide
DVQLVESGGGLVQPGGSLRLSCAASGFSMSNFAMTWVRQAPGEGLEWVSGIRGSGTTYYAESVKGRFTVSRDQSKQTLYLQMQSLRAEDTAIYYCAKTWGTEYFDYWGLGTLVTVSS

SEQ ID NO: 116 - protein, 10 aa, Artificial Sequence
  Description of Artificial Sequence: Synthetic peptide
GFSMSNFAMT

SEQ ID NO: 117 - protein, 16 aa, Artificial Sequence
  Description of Artificial Sequence: Synthetic peptide
GIRGSGTTYYAESVKG

SEQ ID NO: 118 - protein, 9 aa, Artificial Sequence
  Description of Artificial Sequence: Synthetic peptide
TWGTEYFDY

SEQ ID NO: 119 - protein, 108 aa, Artificial Sequence
  Description of Artificial Sequence: Synthetic polypeptide
EIVLTQSPGTLSLSPGERATLSCRASQPIRSYLAWYQQKPGQAPRLLIFSASNRATGIPDRFSGSGSGTEFTLTISSLEPEDFAVYYCQQYYDWPPYTFGGGTKVEIK

SEQ ID NO: 120 - protein, 11 aa, Artificial Sequence
  Description of Artificial Sequence: Synthetic peptide
RASQPIRSYLA

SEQ ID NO: 121 - protein, 7 aa, Artificial Sequence
  Description of Artificial Sequence: Synthetic peptide
SASNRAT

SEQ ID NO: 122 - protein, 10 aa, Artificial Sequence
  Description of Artificial Sequence: Synthetic peptide
QQYYDWPPYT

SEQ ID NO: 123 - protein, 245 aa, Artificial Sequence
  Description of Artificial Sequence: Synthetic polypeptide
EIVLTQSPGTLSLSPGERATLSCRASQPIRSYLAWYQQKPGQAPRLLIFSASNRATGIPDRFSGSGSGTEFTLTISSLEPEDFAVYYCQQYYDWPPYTFGGGTKVEIKGGGGSGGGGSGGGGSGGGGSDVQLVESGGGLVQPGGSLRLSCAASGFSMSNFAMTWVRQAPGEGLEWVSGIRGSGTTYYAESVKGRFTVSRDQSKQTLYLQMQSLRAEDTAIYYCAKTWGTEYFDYWGLGTLVTVSS

SEQ ID NO: 124 - protein, 117 aa, Artificial Sequence
  Description of Artificial Sequence: Synthetic polypeptide
DVQLVESGGGLVQPGGSLRLSCAASGFSMSNFAMTWVRQAPGEGLEWVSGIRGSGTTYYAESVKGRFTVSRDNSKNTLYLQMNSLRAEDTAIYYCAKTWGTEYFDYWGLGTLVTVSS

SEQ ID NO: 125 - protein, 10 aa, Artificial Sequence
  Description of Artificial Sequence: Synthetic peptide
GFSMSNFAMT

SEQ ID NO: 126 - protein, 16 aa, Artificial Sequence
  Description of Artificial Sequence: Synthetic peptide
GIRGSGTTYYAESVKG

SEQ ID NO: 127 - protein, 9 aa, Artificial Sequence
  Description of Artificial Sequence: Synthetic peptide
TWGTEYFDY

SEQ ID NO: 128 - protein, 108 aa, Artificial Sequence
  Description of Artificial Sequence: Synthetic polypeptide
EIVLTQSPGTLSLSPGERATLSCRASQPISSYLAWYQQKPGQAPRLLIFSASNRATGIPDRFSGSGSGTEFTLTISSLEPEDFAVYYCQQYYDWPPYTFGGGTKVEIK

SEQ ID NO: 129 - protein, 11 aa, Artificial Sequence
  Description of Artificial Sequence: Synthetic peptide
RASQPISSYLA

SEQ ID NO: 130 - protein, 7 aa, Artificial Sequence
  Description of Artificial Sequence: Synthetic peptide
SASNRAT

SEQ ID NO: 131 - protein, 10 aa, Artificial Sequence
  Description of Artificial Sequence: Synthetic peptide
QQYYDWPPYT

SEQ ID NO: 132 - protein, 245 aa, Artificial Sequence
  Description of Artificial Sequence: Synthetic polypeptide
EIVLTQSPGTLSLSPGERATLSCRASQPISSYLAWYQQKPGQAPRLLIFSASNRATGIPDRFSGSGSGTEFTLTISSLEPEDFAVYYCQQYYDWPPYTFGGGTKVEIKGGGGSGGGGSGGGGSGGGGSDVQLVESGGGLVQPGGSLRLSCAASGFSMSNFAMTWVRQAPGEGLEWVSGIRGSGTTYYAESVKGRFTVSRDNSKNTLYLQMNSLRAEDTAIYYCAKTWGTEYFDYWGLGTLVTVSS

SEQ ID NO: 133 - protein, 119 aa, Artificial Sequence
  Description of Artificial Sequence: Synthetic polypeptide
DVQLVESGGGVVRPGESLTLSCAASGFTFSNYDMGWVRQAPGEGLEWVSGIRGRGGSTYYADSVKGRFTISRDSSKNTLYLQMNSLRAEDTAVYYCAKENNRHSFFEYWGLGTLVTVSS

SEQ ID NO: 134 - protein, 10 aa, Artificial Sequence
  Description of Artificial Sequence: Synthetic peptide
GFTFSNYDMG

SEQ ID NO: 135 - protein, 17 aa, Artificial Sequence
  Description of Artificial Sequence: Synthetic peptide
GIRGRGGSTYYADSVKG

SEQ ID NO: 136 - protein, 10 aa, Artificial Sequence
  Description of Artificial Sequence: Synthetic peptide
ENNRHSFFEY

SEQ ID NO: 137 - protein, 109 aa, Artificial Sequence
  Description of Artificial Sequence: Synthetic polypeptide
EIVLTQSPGTLSLSPGERATLSCRASQSVGHYLAWYQQKPGQAPRLLIYDASNRAIDIPDRFSGSGSGTEFTLTISRLEPEDFAVYYCQQYYNNWPPLTFGGGTKVEIK

SEQ ID NO: 138 - protein, 11 aa, Artificial Sequence
  Description of Artificial Sequence: Synthetic peptide
RASQSVGHYLA

SEQ ID NO: 139 - protein, 7 aa, Artificial Sequence
  Description of Artificial Sequence: Synthetic peptide
DASNRAI

SEQ ID NO: 140 - protein, 11 aa, Artificial Sequence
  Description of Artificial Sequence: Synthetic peptide
QQYYNDWPPLT

SEQ ID NO: 141 - protein, 248 aa, Artificial Sequence
  Description of Artificial Sequence: Synthetic polypeptide
EIVLTQSPGTLSLSPGERATLSCRASQSVGHYLAWYQQKPGQAPRLLIYDASNRAIDIPDRFSGSGSGTEFTLTISRLEPEDFAVYYCQQYYNNWPPLTFGGGTKVEIKGGGGSGGGGSGGGGSGGGGSDVQLVESGGGVVRPGESLTLSCAASGFTFSNYDMGWVRQAPGEGLEWVSGIRGRGGSTYYADSVKGRFTISRDSSKNTLYLQMNSLRAEDTAVYYCAKENNRHSFFEYWGLGTLVTVSS

SEQ ID NO: 142 - protein, 119 aa, Artificial Sequence
  Description of Artificial Sequence: Synthetic polypeptide
DVQLVESGGGVVRPGESLTLSCAASGFTFSSYDMGWVRQAPGEGLEWVSGIRGRGGSTYYAESVKGRFTISRESSKNTLYLQMNSLRAEDTAVYYCAKENERHSFFEYWGLGTLVTVSS

SEQ ID NO: 143 - protein, 10 aa, Artificial Sequence
  Description of Artificial Sequence: Synthetic peptide
GFTFSSYDMG

SEQ ID NO: 144 - protein, 17 aa, Artificial Sequence
  Description of Artificial Sequence: Synthetic peptide
GIRGRGGSTYYAESVKG

SEQ ID NO: 145 - protein, 10 aa, Artificial Sequence
  Description of Artificial Sequence: Synthetic peptide
ENERHSFFEY

SEQ ID NO: 146 - protein, 109 aa, Artificial Sequence
  Description of Artificial Sequence: Synthetic polypeptide
EIVLTQSPGTLSLSPGERATLSCRASQSVGHYLAWYQQKPGQAPRLLIYDASNRAIDIPDRFSGSGSGTEFTLTISRLEPEDFAVYYCQQYYNDWPPLTFGGGTKVEIK

SEQ ID NO: 147 - protein, 11 aa, Artificial Sequence
  Description of Artificial Sequence: Synthetic peptide
RASQSVGHYLA

SEQ ID NO: 148 - protein, 7 aa, Artificial Sequence
  Description of Artificial Sequence: Synthetic peptide
DASNRAI

SEQ ID NO: 149 - protein, 11 aa, Artificial Sequence
  Description of Artificial Sequence: Synthetic peptide
QQYYNDWPPLT

SEQ ID NO: 150 - protein, 248 aa, Artificial Sequence
  Description of Artificial Sequence: Synthetic polypeptide
EIVLTQSPGTLSLSPGERATLSCRASQSVGHYLAWYQQKPGQAPRLLIYDASNRAIDIPDRFSGSGSGTEFTLTISRLEPEDFAVYYCQQYYNDWPPLTFGGGTKVEIKGGGGSGGGGSGGGGSGGGGSDVQLVESGGGVVRPGESLTLSCAASGFTFSSYDMGWVRQAPGEGLEWVSGIRGRGGSTYYAESVKGRFTISRESSKNTLYLQMNSLRAEDTAVYYCAKENERHSFFEYWGLGTLVTVSS

SEQ ID NO: 151 - protein, 713 aa, Artificial Sequence
  Description of Artificial Sequence: Synthetic polypeptide
EVKLVESEGGLVQPGSSMKLSCTASGFTFSDFYMAWVRQVPEKGLEWVANINYDGSSTYYLDSLKSRFIISRDNARNILYLQMSSLKSEDTATYYCAREGDEGWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQPINNYLAWYQQKPGQAPRLLIFSASNRATGIPDRFSGSGSGTEFTLTISSLEPEDFAVYYCQQYYDWPPYTFGGGTKVEIKGGGGSGGGGSGGGGSGGGGSDVQLVESGGGLVQPGGSLRLSCAASGFSMSNFAMTWVRQAPGEGLEWVSGIRGSGTTYYADSVKGRFTVSRDNSKNTLYLQMNSLRAEDTAIYYCAKTWGTEYFDYWGLGTLVTVSS

SEQ ID NO: 152 - protein, 214 aa, Artificial Sequence; identical to SEQ ID NO: 11
  Description of Artificial Sequence: Synthetic polypeptide

SEQ ID NO: 153 - protein, 712 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARDQSGGGSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQPINNYLAWYQQKPGQAPRLLIFSASNRATGIPDRFSGSGSGTEFTLTISSLEPEDFAVYYCQQYYDWPPYTFGGGTKVEIKGGGGSGGGGSGGGGSGGGGSDVQLVESGGGLVQPGGSLRLSCAASGFSMSNFAMTWVRQAPGEGLEWVSGIRGSGTTYYADSVKGRFTVSRDNSKNTLYLQMNSLRAEDTAIYYCAKTWGTEYFDYWGLGTLVTVSS

SEQ ID NO: 154 - protein, 219 aa, Artificial Sequence; identical to SEQ ID NO: 71
  Description of Artificial Sequence: Synthetic polypeptide

SEQ ID NO: 155 - protein, 716 aa, Artificial Sequence
  Description of Artificial Sequence: Synthetic polypeptide
EVKLVESEGGLVQPGSSMKLSCTASGFTFSDFYMAWVRQVPEKGLEWVANINYDGSSTYYLDSLKSRFIISRDNARNILYLQMSSLKSEDTATYYCAREGDEGWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVGHYLAWYQQKPGQAPRLLIYDASNRAIDIPDRFSGSGSGTEFTLTISRLEPEDFAVYYCQQYYNNWPPLTFGGGTKVEIKGGGGSGGGGSGGGGSGGGGSDVQLVESGGGVVRPGESLTLSCAASGFTFSNYDMGWVRQAPGEGLEWVSGIRGRGGSTYYADSVKGRFTISRDSSKNTLYLQMNSLRAEDTAVYYCAKENNRHSFFEYWGLGTLVTVSS

SEQ ID NO: 156 - protein, 214 aa, Artificial Sequence; identical to SEQ ID NO: 11
  Description of Artificial Sequence: Synthetic polypeptide

SEQ ID NO: 157 - protein, 715 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARDQSGGGSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVGHYLAWYQQKPGQAPRLLIYDASNRAIDIPDRFSGSGSGTEFTLTISRLEPEDFAVYYCQQYYNNWPPLTFGGGTKVEIKGGGGSGGGGSGGGGSGGGGSDVQLVESGGGVVRPGESLTLSCAASGFTFSNYDMGWVRQAPGEGLEWVSGIRGRGGSTYYADSVKGRFTISRDSSKNTLYLQMNSLRAEDTAVYYCAKENNRHSFFEYWGLGTLVTVSS

SEQ ID NO: 158 - protein, 219 aa, Artificial Sequence; identical to SEQ ID NO: 71
  Description of Artificial Sequence: Synthetic polypeptide

SEQ ID NO: 159 - protein, 716 aa, Artificial Sequence
  Description of Artificial Sequence: Synthetic polypeptide
EVQLVESGGGLVQPGGSLRLSCAASGFTFSDFYMSWVRQAPGKGLEWVANINYEGSSKYYVESVKGRFTISRDNAKNILYLQMNSLRAEDTAVYYCAREGDEGWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVGHYLAWYQQKPGQAPRLLIYDASNRAIDIPDRFSGSGSGTEFTLTISRLEPEDFAVYYCQQYYNDWPPLTFGGGTKVEIKGGGGSGGGGSGGGGSGGGGSDVQLVESGGGVVRPGESLTLSCAASGFTFSSYDMGWVRQAPGEGLEWVSGIRGRGGSTYYAESVKGRFTISRESSKNTLYLQMNSLRAEDTAVYYCAKENERHSFFEYWGLGTLVTVSS

SEQ ID NO: 160 - protein, 214 aa, Artificial Sequence; identical to SEQ ID NO: 21
  Description of Artificial Sequence: Synthetic polypeptide

SEQ ID NO: 161 - protein, 119 aa, Artificial Sequence; identical to SEQ ID NO: 20
  Description of Artificial Sequence: Synthetic polypeptide

SEQ ID NO: 162 - protein, 107 aa, Artificial Sequence; identical to SEQ ID NO: 25
  Description of Artificial Sequence: Synthetic polypeptide

SEQ ID NO: 163 - protein, 248 aa, Artificial Sequence; identical to SEQ ID NO: 150
  Description of Artificial Sequence: Synthetic polypeptide

SEQ ID NO: 164 - protein, 713 aa, Artificial Sequence
  Description of Artificial Sequence: Synthetic polypeptide
EVQLVESGGGLVQPGGSLRLSCAASGFTFSDFYMSWVRQAPGKGLEWVANINYEGSSKYYVESVKGRFTISRDNAKNILYLQMNSLRAEDTAVYYCAREGDEGWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQPIRSYLAWYQQKPGQAPRLLIFSASNRATGIPDRFSGSGSGTEFTLTISSLEPEDFAVYYCQQYYDWPPYTFGGGTKVEIKGGGGSGGGGSGGGGSGGGGSDVQLVESGGGLVQPGGSLRLSCAASGFSMSNFAMTWVRQAPGEGLEWVSGIRGSGTTYYAESVKGRFTVSRDQSKQTLYLQMQSLRAEDTAIYYCAKTWGTEYFDYWGLGTLVTVSS

SEQ ID NO: 165 - protein, 214 aa, Artificial Sequence; identical to SEQ ID NO: 21
  Description of Artificial Sequence: Synthetic polypeptide

SEQ ID NO: 166 - protein, 119 aa, Artificial Sequence; identical to SEQ ID NO: 20
  Description of Artificial Sequence: Synthetic polypeptide

SEQ ID NO: 167 - protein, 107 aa, Artificial Sequence; identical to SEQ ID NO: 25
  Description of Artificial Sequence: Synthetic polypeptide

SEQ ID NO: 168 - protein, 245 aa, Artificial Sequence; identical to SEQ ID NO: 123
  Description of Artificial Sequence: Synthetic polypeptide

SEQ ID NO: 169 - protein, 713 aa, Artificial Sequence
  Description of Artificial Sequence: Synthetic polypeptide
EVQLVESGGGLVQPGGSLRLSCAASGFTFSDFYMSWVRQAPGKGLEWVANINYEGSSKYYVESVKGRFTISRDNAKNILYLQMNSLRAEDTAVYYCAREGDEGWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQPISSYLAWYQQKPGQAPRLLIFSASNRATGIPDRFSGSGSGTEFTLTISSLEPEDFAVYYCQQYYDWPPYTFGGGTKVEIKGGGGSGGGGSGGGGSGGGGSDVQLVESGGGLVQPGGSLRLSCAASGFSMSNFAMTWVRQAPGEGLEWVSGIRGSGTTYYAESVKGRFTVSRDNSKNTLYLQMNSLRAEDTAIYYCAKTWGTEYFDYWGLGTLVTVSS

SEQ ID NO: 170 - protein, 214 aa, Artificial Sequence; identical to SEQ ID NO: 21
  Description of Artificial Sequence: Synthetic polypeptide

SEQ ID NO: 171 - protein, 119 aa, Artificial Sequence; identical to SEQ ID NO: 20
  Description of Artificial Sequence: Synthetic polypeptide

SEQ ID NO: 172 - protein, 107 aa, Artificial Sequence; identical to SEQ ID NO: 25
  Description of Artificial Sequence: Synthetic polypeptide

SEQ ID NO: 173 - protein, 245 aa, Artificial Sequence; identical to SEQ ID NO: 132
  Description of Artificial Sequence: Synthetic polypeptide

SEQ ID NO: 174 - protein, 716 aa, Artificial Sequence
  Description of Artificial Sequence: Synthetic polypeptide
EVQLVESGGGLVQPGGSLRLSCAASGFTFSDFYMSWVRQAPGKGLEWVANINYEASSKYYVDSLKGRFTISRDNAKNILYLQMNSLRAEDTAVYYCAREGDEGWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVGHYLAWYQQKPGQAPRLLIYDASNRAIDIPDRFSGSGSGTEFTLTISRLEPEDFAVYYCQQYYNDWPPLTFGGGTKVEIKGGGGSGGGGSGGGGSGGGGSDVQLVESGGGVVRPGESLTLSCAASGFTFSSYDMGWVRQAPGEGLEWVSGIRGRGGSTYYAESVKGRFTISRESSKNTLYLQMNSLRAEDTAVYYCAKENERHSFFEYWGLGTLVTVSS

SEQ ID NO: 175 - protein, 214 aa, Artificial Sequence; identical to SEQ ID NO: 31
  Description of Artificial Sequence: Synthetic polypeptide

SEQ ID NO: 176 - protein, 119 aa, Artificial Sequence; identical to SEQ ID NO: 30
  Description of Artificial Sequence: Synthetic polypeptide

SEQ ID NO: 177 - protein, 107 aa, Artificial Sequence; identical to SEQ ID NO: 35
  Description of Artificial Sequence: Synthetic polypeptide

SEQ ID NO: 178 - protein, 248 aa, Artificial Sequence; identical to SEQ ID NO: 150
  Description of Artificial Sequence: Synthetic polypeptide

SEQ ID NO: 179 - protein, 713 aa, Artificial Sequence
  Description of Artificial Sequence: Synthetic polypeptide
EVQLVESGGGLVQPGGSLRLSCAASGFTFSDFYMSWVRQAPGKGLEWVANINYEASSKYYVDSLKGRFTISRDNAKNILYLQMNSLRAEDTAVYYCAREGDEGWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQPIRSYLAWYQQKPGQAPRLLIFSASNRATGIPDRFSGSGSGTEFTLTISSLEPEDFAVYYCQQYYDWPPYTFGGGTKVEIKGGGGSGGGGSGGGGSGGGGSDVQLVESGGGLVQPGGSLRLSCAASGFSMSNFAMTWVRQAPGEGLEWVSGIRGSGTTYYAESVKGRFTVSRDQSKQTLYLQMQSLRAEDTAIYYCAKTWGTEYFDYWGLGTLVTVSS

SEQ ID NO: 180 - protein, 214 aa, Artificial Sequence; identical to SEQ ID NO: 31
  Description of Artificial Sequence: Synthetic polypeptide

SEQ ID NO: 181 - protein, 119 aa, Artificial Sequence; identical to SEQ ID NO: 30
  Description of Artificial Sequence: Synthetic polypeptide

SEQ ID NO: 182 - protein, 107 aa, Artificial Sequence; identical to SEQ ID NO: 35
  Description of Artificial Sequence: Synthetic polypeptide

SEQ ID NO: 183 - protein, 245 aa, Artificial Sequence; identical to SEQ ID NO: 123
  Description of Artificial Sequence: Synthetic polypeptide

SEQ ID NO: 184 - protein, 713 aa, Artificial Sequence
  Description of Artificial Sequence: Synthetic polypeptide
EVQLVESGGGLVQPGGSLRLSCAASGFTFSDFYMSWVRQAPGKGLEWVANINYEASSKYYVDSLKGRFTISRDNAKNILYLQMNSLRAEDTAVYYCAREGDEGWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQPISSYLAWYQQKPGQAPRLLIFSASNRATGIPDRFSGSGSGTEFTLTISSLEPEDFAVYYCQQYYDWPPYTFGGGTKVEIKGGGGSGGGGSGGGGSGGGGSDVQLVESGGGLVQPGGSLRLSCAASGFSMSNFAMTWVRQAPGEGLEWVSGIRGSGTTYYAESVKGRFTVSRDNSKNTLYLQMNSLRAEDTAIYYCAKTWGTEYFDYWGLGTLVTVSS

SEQ ID NO: 185 - protein, 214 aa, Artificial Sequence; identical to SEQ ID NO: 31
  Description of Artificial Sequence: Synthetic polypeptide

SEQ ID NO: 186 - protein, 119 aa, Artificial Sequence; identical to SEQ ID NO: 30
  Description of Artificial Sequence: Synthetic polypeptide

SEQ ID NO: 187 - protein, 107 aa, Artificial Sequence; identical to SEQ ID NO: 35
  Description of Artificial Sequence: Synthetic polypeptide

SEQ ID NO: 188 - protein, 245 aa, Artificial Sequence; identical to SEQ ID NO: 132
  Description of Artificial Sequence: Synthetic polypeptide

SEQ ID NO: 189 - protein, 716 aa, Artificial Sequence
  Description of Artificial Sequence: Synthetic polypeptide
EVQLVESGGGLVQPGGSLRLSCAASGFTFSDFYMSWVRQAPGKGLEWVANIQYEGSSKYYVESLKGRFTISRDNAKNILYLQMNSLRAEDTAVYYCAREGDEGWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVGHYLAWYQQKPGQAPRLLIYDASNRAIDIPDRFSGSGSGTEFTLTISRLEPEDFAVYYCQQYYNDWPPLTFGGGTKVEIKGGGGSGGGGSGGGGSGGGGSDVQLVESGGGVVRPGESLTLSCAASGFTFSSYDMGWVRQAPGEGLEWVSGIRGRGGSTYYAESVKGRFTISRESSKNTLYLQMNSLRAEDTAVYYCAKENERHSFFEYWGLGTLVTVSS

SEQ ID NO: 190 - protein, 214 aa, Artificial Sequence; identical to SEQ ID NO: 41
  Description of Artificial Sequence: Synthetic polypeptide

SEQ ID NO: 191 - protein, 119 aa, Artificial Sequence; identical to SEQ ID NO: 40
  Description of Artificial Sequence: Synthetic polypeptide

SEQ ID NO: 192 - protein, 107 aa, Artificial Sequence; identical to SEQ ID NO: 45
  Description of Artificial Sequence: Synthetic polypeptide

SEQ ID NO: 193 - protein, 248 aa, Artificial Sequence; identical to SEQ ID NO: 150
  Description of Artificial Sequence: Synthetic polypeptide

SEQ ID NO: 194 - protein, 713 aa, Artificial Sequence
  Description of Artificial Sequence: Synthetic polypeptide
EVQLVESGGGLVQPGGSLRLSCAASGFTFSDFYMSWVRQAPGKGLEWVANIQYEGSSKYYVESLKGRFTISRDNAKNILYLQMNSLRAEDTAVYYCAREGDEGWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQPIRSYLAWYQQKPGQAPRLLIFSASNRATGIPDRFSGSGSGTEFTLTISSLEPEDFAVYYCQQYYDWPPYTFGGGTKVEIKGGGGSGGGGSGGGGSGGGGSDVQLVESGGGLVQPGGSLRLSCAASGFSMSNFAMTWVRQAPGEGLEWVSGIRGSGTTYYAESVKGRFTVSRDQSKQTLYLQMQSLRAEDTAIYYCAKTWGTEYFDYWGLGTLVTVSS

SEQ ID NO: 195 - protein, 214 aa, Artificial Sequence; identical to SEQ ID NO: 41
  Description of Artificial Sequence: Synthetic polypeptide

SEQ ID NO: 196 - protein, 119 aa, Artificial Sequence; identical to SEQ ID NO: 40
  Description of Artificial Sequence: Synthetic polypeptide

SEQ ID NO: 197 - protein, 107 aa, Artificial Sequence; identical to SEQ ID NO: 45
  Description of Artificial Sequence: Synthetic polypeptide

SEQ ID NO: 198 - protein, 246 aa, Artificial Sequence
  Description of Artificial Sequence: Synthetic polypeptide
SEIVLTQSPGTLSLSPGERATLSCRASQPIRSYLAWYQQKPGQAPRLLIFSASNRATGIPDRFSGSGSGTEFTLTISSLEPEDFAVYYCQQYYDWPPYTFGGGTKVEIKGGGGSGGGGSGGGGSGGGGSDVQLVESGGGLVQPGGSLRLSCAASGFSMSNFAMTWVRQAPGEGLEWVSGIRGSGTTYYAESVKGRFTVSRDQSKQTLYLQMQSLRAEDTAIYYCAKTWGTEYFDYWGLGTLVTVSS

SEQ ID NO: 199 - protein, 713 aa, Artificial Sequence
  Description of Artificial Sequence: Synthetic polypeptide
EVQLVESGGGLVQPGGSLRLSCAASGFTFSDFYMSWVRQAPGKGLEWVANIQYEGSSKYYVESLKGRFTISRDNAKNILYLQMNSLRAEDTAVYYCAREGDEGWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQPISSYLAWYQQKPGQAPRLLIFSASNRATGIPDRFSGSGSGTEFTLTISSLEPEDFAVYYCQQYYDWPPYTFGGGTKVEIKGGGGSGGGGSGGGGSGGGGSDVQLVESGGGLVQPGGSLRLSCAASGFSMSNFAMTWVRQAPGEGLEWVSGIRGSGTTYYAESVKGRFTVSRDNSKNTLYLQMNSLRAEDTAIYYCAKTWGTEYFDYWGLGTLVTVSS

SEQ ID NO: 200 - protein, 214 aa, Artificial Sequence; identical to SEQ ID NO: 41
  Description of Artificial Sequence: Synthetic polypeptide

SEQ ID NO: 201 - protein, 119 aa, Artificial Sequence; identical to SEQ ID NO: 40
  Description of Artificial Sequence: Synthetic polypeptide

SEQ ID NO: 202 - protein, 107 aa, Artificial Sequence; identical to SEQ ID NO: 45
  Description of Artificial Sequence: Synthetic polypeptide

SEQ ID NO: 203 - protein, 245 aa, Artificial Sequence; identical to SEQ ID NO: 132
  Description of Artificial Sequence: Synthetic polypeptide

SEQ ID NO: 204 - protein, 716 aa, Artificial Sequence; identical to SEQ ID NO: 189
  Description of Artificial Sequence: Synthetic polypeptide

SEQ ID NO: 205 - protein, 214 aa, Artificial Sequence; identical to SEQ ID NO: 51
  Description of Artificial Sequence: Synthetic polypeptide

SEQ ID NO: 206 - protein, 119 aa, Artificial Sequence; identical to SEQ ID NO: 40
  Description of Artificial Sequence: Synthetic polypeptide

SEQ ID NO: 207 - protein, 107 aa, Artificial Sequence; identical to SEQ ID NO: 55
  Description of Artificial Sequence: Synthetic polypeptide

SEQ ID NO: 208 - protein, 248 aa, Artificial Sequence; identical to SEQ ID NO: 150
  Description of Artificial Sequence: Synthetic polypeptide

SEQ ID NO: 209 - protein, 713 aa, Artificial Sequence; identical to SEQ ID NO: 194
  Description of Artificial Sequence: Synthetic polypeptide

SEQ ID NO: 210 - protein, 214 aa, Artificial Sequence; identical to SEQ ID NO: 51
  Description of Artificial Sequence: Synthetic polypeptide

SEQ ID NO: 211 - protein, 123 aa, Artificial Sequence
  Description of Artificial Sequence: Synthetic polypeptide
EVQLVESGGGLVQPGGSLRLSCAASGFTFSDFYMSWVRQAPGKGLEWVANIQYEGSSKYYVESLKGRFTISRDNAKNILYLQMNSLRAEDTAVYYCAREGDEGWYFDVWGQGTTVTVSSASTK

SEQ ID NO: 212 - protein, 107 aa, Artificial Sequence; identical to SEQ ID NO: 55
  Description of Artificial Sequence: Synthetic polypeptide

SEQ ID NO: 213 - protein, 245 aa, Artificial Sequence; identical to SEQ ID NO: 123
  Description of Artificial Sequence: Synthetic polypeptide

SEQ ID NO: 214 - protein, 713 aa, Artificial Sequence; identical to SEQ ID NO: 199
  Description of Artificial Sequence: Synthetic polypeptide

SEQ ID NO: 215 - protein, 214 aa, Artificial Sequence; identical to SEQ ID NO: 51
  Description of Artificial Sequence: Synthetic polypeptide

SEQ ID NO: 216 - protein, 119 aa, Artificial Sequence; identical to SEQ ID NO: 40
  Description of Artificial Sequence: Synthetic polypeptide

SEQ ID NO: 217 - protein, 107 aa, Artificial Sequence; identical to SEQ ID NO: 55
  Description of Artificial Sequence: Synthetic polypeptide

SEQ ID NO: 218 - protein, 245 aa, Artificial Sequence; identical to SEQ ID NO: 132
  Description of Artificial Sequence: Synthetic polypeptide

SEQ ID NO: 219 - protein, 716 aa, Artificial Sequence; identical to SEQ ID NO: 159
  Description of Artificial Sequence: Synthetic polypeptide

SEQ ID NO: 220 - protein, 214 aa, Artificial Sequence; identical to SEQ ID NO: 51
  Description of Artificial Sequence: Synthetic polypeptide

SEQ ID NO: 221 - protein, 119 aa, Artificial Sequence; identical to SEQ ID NO: 20
  Description of Artificial Sequence: Synthetic polypeptide

SEQ ID NO: 222 - protein, 107 aa, Artificial Sequence; identical to SEQ ID NO: 55
  Description of Artificial Sequence: Synthetic polypeptide

SEQ ID NO: 223 - protein, 248 aa, Artificial Sequence; identical to SEQ ID NO: 150
  Description of Artificial Sequence: Synthetic polypeptide

SEQ ID NO: 224 - protein, 713 aa, Artificial Sequence; identical to SEQ ID NO: 164
  Description of Artificial Sequence: Synthetic polypeptide

SEQ ID NO: 225 - protein, 214 aa, Artificial Sequence; identical to SEQ ID NO: 51
  Description of Artificial Sequence: Synthetic polypeptide

SEQ ID NO: 226 - protein, 117 aa, Artificial Sequence
  Description of Artificial Sequence: Synthetic polypeptide
EVQLVESGGGLVQPGGSLRLSCAASGFTFSDFYMSWVRQAPGKGLEWVANINYEGSSKYYVESVKGRFTISRDNAKNILYLQMNSLRAEDTAVYYCAREGDEGWYFDVWGQGTTVTV

SEQ ID NO: 227 - protein, 107 aa, Artificial Sequence; identical to SEQ ID NO: 55
  Description of Artificial Sequence: Synthetic polypeptide

SEQ ID NO: 228 - protein, 245 aa, Artificial Sequence; identical to SEQ ID NO: 123
  Description of Artificial Sequence: Synthetic polypeptide

SEQ ID NO: 229 - protein, 713 aa, Artificial Sequence; identical to SEQ ID NO: 169
  Description of Artificial Sequence: Synthetic polypeptide

SEQ ID NO: 230 - protein, 214 aa, Artificial Sequence; identical to SEQ ID NO: 51
  Description of Artificial Sequence: Synthetic polypeptide

SEQ ID NO: 231 - protein, 119 aa, Artificial Sequence; identical to SEQ ID NO: 20
  Description of Artificial Sequence: Synthetic polypeptide

SEQ ID NO: 232 - protein, 107 aa, Artificial Sequence; identical to SEQ ID NO: 55
  Description of Artificial Sequence: Synthetic polypeptide

SEQ ID NO: 233 - protein, 245 aa, Artificial Sequence; identical to SEQ ID NO: 132
  Description of Artificial Sequence: Synthetic polypeptide

SEQ ID NO: 234 - protein, 715 aa, Artificial Sequence
  Description of Artificial Sequence: Synthetic polypeptide
QVQLQESGPGLVKPSETLSLTCTVSGGSISSYYWSWIRQPPGKGLEWMGYIYYSGSTNINPSLKSRVTISVDTSKNQFSLKLSSVTAADTAVYYCARDQSGGGSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVGHYLAWYQQKPGQAPRLLIYDASNRAIDIPDRFSGSGSGTEFTLTISRLEPEDFAVYYCQQYYNDWPPLTFGGGTKVEIKGGGGSGGGGSGGGGSGGGGSDVQLVESGGGVVRPGESLTLSCAASGFTFSSYDMGWVRQAPGEGLEWVSGIRGRGGSTYYAESVKGRFTISRESSKNTLYLQMNSLRAEDTAVYYCAKENERHSFFEYWGLGTLVTVSS

SEQ ID NO: 235 - protein, 219 aa, Artificial Sequence; identical to SEQ ID NO: 71
  Description of Artificial Sequence: Synthetic polypeptide

SEQ ID NO: 236 - protein, 118 aa, Artificial Sequence; identical to SEQ ID NO: 80
  Description of Artificial Sequence: Synthetic polypeptide

SEQ ID NO: 237 - protein, 112 aa, Artificial Sequence; identical to SEQ ID NO: 75
  Description of Artificial Sequence: Synthetic polypeptide

SEQ ID NO: 238 - protein, 248 aa, Artificial Sequence; identical to SEQ ID NO: 150
  Description of Artificial Sequence: Synthetic polypeptide

SEQ ID NO: 239 - protein, 712 aa, Artificial Sequence
  Description of Artificial Sequence: Synthetic polypeptide
QVQLQESGPGLVKPSETLSLTCTVSGGSISSYYWSWIRQPPGKGLEWMGYIYYSGSTNINPSLKSRVTISVDTSKNQFSLKLSSVTAADTAVYYCARDQSGGGSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQPIRSYLAWYQQKPGQAPRLLIFSASNRATGIPDRFSGSGSGTEFTLTISSLEPEDFAVYYCQQYYDWPPYTFGGGTKVEIKGGGGSGGGGSGGGGSGGGGSDVQLVESGGGLVQPGGSLRLSCAASGFSMSNFAMTWVRQAPGEGLEWVSGIRGSGTTYYAESVKGRFTVSRDQSKQTLYLQMQSLRAEDTAIYYCAKTWGTEYFDYWGLGTLVTVSS

SEQ ID NO: 240 - protein, 219 aa, Artificial Sequence; identical to SEQ ID NO: 71
  Description of Artificial Sequence: Synthetic polypeptide

SEQ ID NO: 241 - protein, 118 aa, Artificial Sequence; identical to SEQ ID NO: 80
  Description of Artificial Sequence: Synthetic polypeptide

SEQ ID NO: 242 - protein, 112 aa, Artificial Sequence; identical to SEQ ID NO: 75
  Description of Artificial Sequence: Synthetic polypeptide

SEQ ID NO: 243 - protein, 245 aa, Artificial Sequence; identical to SEQ ID NO: 123
  Description of Artificial Sequence: Synthetic polypeptide

SEQ ID NO: 244 - protein, 712 aa, Artificial Sequence
  Description of Artificial Sequence: Synthetic polypeptide
QVQLQESGPGLVKPSETLSLTCTVSGGSISSYYWSWIRQPPGKGLEWMGYIYYSGSTNINPSLKSRVTISVDTSKNQFSLKLSSVTAADTAVYYCARDQSGGGSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQPISSYLAWYQQKPGQAPRLLIFSASNRATGIPDRFSGSGSGTEFTLTISSLEPEDFAVYYCQQYYDWPPYTFGGGTKVEIKGGGGSGGGGSGGGGSGGGGSDVQLVESGGGLVQPGGSLRLSCAASGFSMSNFAMTWVRQAPGEGLEWVSGIRGSGTTYYAESVKGRFTVSRDNSKNTLYLQMNSLRAEDTAIYYCAKTWGTEYFDYWGLGTLVTVSS

SEQ ID NO: 245 - protein, 219 aa, Artificial Sequence; identical to SEQ ID NO: 71
  Description of Artificial Sequence: Synthetic polypeptide

SEQ ID NO: 246 - protein, 118 aa, Artificial Sequence; identical to SEQ ID NO: 80
  Description of Artificial Sequence: Synthetic polypeptide

SEQ ID NO: 247 - protein, 112 aa, Artificial Sequence; identical to SEQ ID NO: 75
  Description of Artificial Sequence: Synthetic polypeptide

SEQ ID NO: 248 - protein, 245 aa, Artificial Sequence; identical to SEQ ID NO: 132
  Description of Artificial Sequence: Synthetic polypeptide

SEQ ID NO: 249 - protein, 715 aa, Artificial Sequence; identical to SEQ ID NO: 234
  Description of Artificial Sequence: Synthetic polypeptide

SEQ ID NO: 250 - protein, 219 aa, Artificial Sequence; identical to SEQ ID NO: 91
  Description of Artificial Sequence: Synthetic polypeptide

SEQ ID NO: 251 - protein, 118 aa, Artificial Sequence; identical to SEQ ID NO: 80
  Description of Artificial Sequence: Synthetic polypeptide

SEQ ID NO: 252 - protein, 112 aa, Artificial Sequence; identical to SEQ ID NO: 95
  Description of Artificial Sequence: Synthetic polypeptide

SEQ ID NO: 253 - protein, 248 aa, Artificial Sequence; identical to SEQ ID NO: 150
  Description of Artificial Sequence: Synthetic polypeptide

SEQ ID NO: 254 - protein, 712 aa, Artificial Sequence; identical to SEQ ID NO: 239
  Description of Artificial Sequence: Synthetic polypeptide

SEQ ID NO: 255 - protein, 219 aa, Artificial Sequence; identical to SEQ ID NO: 91
  Description of Artificial Sequence: Synthetic polypeptide

SEQ ID NO: 256 - protein, 118 aa, Artificial Sequence; identical to SEQ ID NO: 80
  Description of Artificial Sequence: Synthetic polypeptide

SEQ ID NO: 257 - protein, 112 aa, Artificial Sequence; identical to SEQ ID NO: 95
  Description of Artificial Sequence: Synthetic polypeptide

SEQ ID NO: 258 - protein, 245 aa, Artificial Sequence; identical to SEQ ID NO: 123
  Description of Artificial Sequence: Synthetic polypeptide

SEQ ID NO: 259 - protein, 712 aa, Artificial Sequence; identical to SEQ ID NO: 244
  Description of Artificial Sequence: Synthetic polypeptide

SEQ ID NO: 260 - protein, 219 aa, Artificial Sequence; identical to SEQ ID NO: 91
  Description of Artificial Sequence: Synthetic polypeptide

SEQ ID NO: 261 - protein, 118 aa, Artificial Sequence; identical to SEQ ID NO: 80
  Description of Artificial Sequence: Synthetic polypeptide

SEQ ID NO: 262 - protein, 112 aa, Artificial Sequence; identical to SEQ ID NO: 95
  Description of Artificial Sequence: Synthetic polypeptide

SEQ ID NO: 263 - protein, 245 aa, Artificial Sequence; identical to SEQ ID NO: 132
  Description of Artificial Sequence: Synthetic polypeptide

SEQ ID NO: 264 - protein, 715 aa, Artificial Sequence
  Description of Artificial Sequence: Synthetic polypeptide
QVQLQESGPGLVKPSETLSLTCTVSGGSISSYYWSWIRQPPGKGLEWMGYIYYSGSTQYNPSLKSRVTISVDTSKNQFSLKLSSVTAADTAVYYCARDQSGGGSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVGHYLAWYQQKPGQAPRLLIYDASNRAIDIPDRFSGSGSGTEFTLTISRLEPEDFAVYYCQQYYNDWPPLTFGGGTKVEIKGGGGSGGGGSGGGGSGGGGSDVQLVESGGGVVRPGESLTLSCAASGFTFSSYDMGWVRQAPGEGLEWVSGIRGRGGSTYYAESVKGRFTISRESSKNTLYLQMNSLRAEDTAVYYCAKENERHSFFEYWGLGTLVTVSS

SEQ ID NO: 265 - protein, 219 aa, Artificial Sequence; identical to SEQ ID NO: 91
  Description of Artificial Sequence: Synthetic polypeptide

SEQ ID NO: 266 - protein, 118 aa, Artificial Sequence; identical to SEQ ID NO: 100
  Description of Artificial Sequence: Synthetic polypeptide

SEQ ID NO: 267 - protein, 112 aa, Artificial Sequence; identical to SEQ ID NO: 95
  Description of Artificial Sequence: Synthetic polypeptide

SEQ ID NO: 268 - protein, 248 aa, Artificial Sequence; identical to SEQ ID NO: 150
  Description of Artificial Sequence: Synthetic polypeptide

SEQ ID NO: 269 - protein, 712 aa, Artificial Sequence
  Description of Artificial Sequence: Synthetic polypeptide
QVQLQESGPGLVKPSETLSLTCTVSGGSISSYYWSWIRQPPGKGLEWMGYIYYSGSTQYNPSLKSRVTISVDTSKNQFSLKLSSVTAADTAVYYCARDQSGGGSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQPIRSYLAWYQQKPGQAPRLLIFSASNRATGIPDRFSGSGSGTEFTLTISSLEPEDFAVYYCQQYYDWPPYTFGGGTKVEIKGGGGSGGGGSGGGGSGGGGSDVQLVESGGGLVQPGGSLRLSCAASGFSMSNFAMTWVRQAPGEGLEWVSGIRGSGTTYYAESVKGRFTVSRDQSKQTLYLQMQSLRAEDTAIYYCAKTWGTEYFDYWGLGTLVTVSS

SEQ ID NO: 270 - protein, 219 aa, Artificial Sequence; identical to SEQ ID NO: 91
  Description of Artificial Sequence: Synthetic polypeptide

SEQ ID NO: 271 - protein, 118 aa, Artificial Sequence; identical to SEQ ID NO: 100
  Description of Artificial Sequence: Synthetic polypeptide

SEQ ID NO: 272 - protein, 112 aa, Artificial Sequence; identical to SEQ ID NO: 95
  Description of Artificial Sequence: Synthetic polypeptide

SEQ ID NO: 273 - protein, 245 aa, Artificial Sequence; identical to SEQ ID NO: 123
  Description of Artificial Sequence: Synthetic polypeptide

SEQ ID NO: 274 - protein, 712 aa, Artificial Sequence
  Description of Artificial Sequence: Synthetic polypeptide
QVQLQESGPGLVKPSETLSLTCTVSGGSISSYYWSWIRQPPGKGLEWMGYIYYSGSTQYNPSLKSRVTISVDTSKNQFSLKLSSVTAADTAVYYCARDQSGGGSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQPISSYLAWYQQKPGQAPRLLIFSASNRATGIPDRFSGSGSGTEFTLTISSLEPEDFAVYYCQQYYDWPPYTFGGGTKVEIKGGGGSGGGGSGGGGSGGGGSDVQLVESGGGLVQPGGSLRLSCAASGFSMSNFAMTWVRQAPGEGLEWVSGIRGSGTTYYAESVKGRFTVSRDNSKNTLYLQMNSLRAEDTAIYYCAKTWGTEYFDYWGLGTLVTVSS

SEQ ID NO: 275 - protein, 219 aa, Artificial Sequence; identical to SEQ ID NO: 91
  Description of Artificial Sequence: Synthetic polypeptide

SEQ ID NO: 276 - protein, 118 aa, Artificial Sequence; identical to SEQ ID NO: 100
  Description of Artificial Sequence: Synthetic polypeptide

SEQ ID NO: 277 - protein, 112 aa, Artificial Sequence; identical to SEQ ID NO: 95
  Description of Artificial Sequence: Synthetic polypeptide

SEQ ID NO: 278 - protein, 245 aa, Artificial Sequence; identical to SEQ ID NO: 132
  Description of Artificial Sequence: Synthetic polypeptide

SEQ ID NO: 279 - protein, 4 aa, Artificial Sequence
  Description of Artificial Sequence: Synthetic peptide
GGGS

SEQ ID NO: 280 - protein, 6 aa, Artificial Sequence
  Description of Artificial Sequence: Synthetic peptide
GGSGGS

SEQ ID NO: 281 - protein, 10 aa, Artificial Sequence
  Description of Artificial Sequence: Synthetic peptide
GGGGSGGGGS

SEQ ID NO: 282 - protein, 20 aa, Artificial Sequence
  Description of Artificial Sequence: Synthetic peptide
GGGGSGGGGSGGGGSGGGGS

SEQ ID NO: 283 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 284 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 285 - protein, 107 aa, Artificial Sequence [sequence omitted]

SEQ ID NO: 286 - protein, 8 aa, Artificial Sequence
  Description of Artificial Sequence: Synthetic peptide
GFTFSDFY

SEQ ID NO: 287 - protein, 8 aa, Artificial Sequence
  Description of Artificial Sequence: Synthetic peptide
INYDGSST

SEQ ID NO: 288 - protein, 6 aa, Artificial Sequence
  Description of Artificial Sequence: Synthetic peptide
QDVSTA

SEQ ID NO: 289 - protein, 7 aa, Artificial Sequence
  Description of Artificial Sequence: Synthetic peptide
HYSNPWT

SEQ ID NO: 290 - protein, 5 aa, Artificial Sequence
  Description of Artificial Sequence: Synthetic peptide
DFYMA

SEQ ID NO: 291 - protein, 7 aa, Artificial Sequence
  Description of Artificial Sequence: Synthetic peptide
GFTFSDF

SEQ ID NO: 292 - protein, 6 aa, Artificial Sequence
  Description of Artificial Sequence: Synthetic peptide
NYDGSS

SEQ ID NO: 293 - protein, 8 aa, Artificial Sequence
  Description of Artificial Sequence: Synthetic peptide
INYEGSSK

SEQ ID NO: 294 - protein, 6 aa, Artificial Sequence
  Description of Artificial Sequence: Synthetic peptide
QDISSA

SEQ ID NO: 295 - protein, 5 aa, Artificial Sequence
  Description of Artificial Sequence: Synthetic peptide
DFYMS

SEQ ID NO: 296 - protein, 6 aa, Artificial Sequence
  Description of Artificial Sequence: Synthetic peptide
NYEGSS

SEQ ID NO: 297 - protein, 8 aa, Artificial Sequence
  Description of Artificial Sequence: Synthetic peptide
INYEASSK

SEQ ID NO: 298 - protein, 6 aa, Artificial Sequence
  Description of Artificial Sequence: Synthetic peptide
QSVSSA

SEQ ID NO: 299 - protein, 6 aa, Artificial Sequence
  Description of Artificial Sequence: Synthetic peptide
NYEASS

SEQ ID NO: 300 - protein, 8 aa, Artificial Sequence
  Description of Artificial Sequence: Synthetic peptide
IQYEGSSK

SEQ ID NO: 301 - protein, 6 aa, Artificial Sequence
  Description of Artificial Sequence: Synthetic peptide
QSISTA

SEQ ID NO: 302 - protein, 6 aa, Artificial Sequence
  Description of Artificial Sequence: Synthetic peptide
QYEGSS

SEQ ID NO: 303 - protein, 8 aa, Artificial Sequence
  Description of Artificial Sequence: Synthetic peptide
INYEGSSK

SEQ ID NO: 304 - protein, 8 aa, Artificial Sequence
  Description of Artificial Sequence: Synthetic peptide
GGSISSYY

SEQ ID NO: 305 - protein, 7 aa, Artificial Sequence
  Description of Artificial Sequence: Synthetic peptide
IYYSGST

SEQ ID NO: 306 - protein, 11 aa, Artificial Sequence
  Description of Artificial Sequence: Synthetic peptide
QSLLYSNGYNH

SEQ ID NO: 307 - protein, 9 aa, Artificial Sequence
  Description of Artificial Sequence: Synthetic peptide
MQALQTPPT

SEQ ID NO: 308 - protein, 5 aa, Artificial Sequence
  Description of Artificial Sequence: Synthetic peptide
SYYWS

SEQ ID NO: 309 - protein, 7 aa, Artificial Sequence
  Description of Artificial Sequence: Synthetic peptide
GGSISSY

SEQ ID NO: 310 - protein, 5 aa, Artificial Sequence
  Description of Artificial Sequence: Synthetic peptide
YYSGS

SEQ ID NO: 311 - protein, 7 aa, Artificial Sequence
  Description of Artificial Sequence: Synthetic peptide
IYYSGST

SEQ ID NO: 312 - protein, 13 aa, Artificial Sequence
  Description of Artificial Sequence: Synthetic peptide
SSQSLLYSNGYNH

SEQ ID NO: 313 - protein, 11 aa, Artificial Sequence
  Description of Artificial Sequence: Synthetic peptide
QSLLYSQGYNH

SEQ ID NO: 314 - protein, 7 aa, Artificial Sequence
  Description of Artificial Sequence: Synthetic peptide
IYYSGST

SEQ ID NO: 315 - protein, 8 aa, Artificial Sequence
  Description of Artificial Sequence: Synthetic peptide
GFSMSNFA

SEQ ID NO: 316 - protein, 7 aa, Artificial Sequence
  Description of Artificial Sequence: Synthetic peptide
IRGSGTT

SEQ ID NO: 317 - protein, 6 aa, Artificial Sequence
  Description of Artificial Sequence: Synthetic peptide
QPINNY

SEQ ID NO: 318 - protein, 10 aa, Artificial Sequence
  Description of Artificial Sequence: Synthetic peptide
QQYYDWPPYT

SEQ ID NO: 319 - protein, 5 aa, Artificial Sequence
  Description of Artificial Sequence: Synthetic peptide
NFAMT

SEQ ID NO: 320 - protein, 7 aa, Artificial Sequence
  Description of Artificial Sequence: Synthetic peptide
GFSMSNF

SEQ ID NO: 321 - protein, 5 aa, Artificial Sequence
  Description of Artificial Sequence: Synthetic peptide
RGSGT

SEQ ID NO: 322 - protein, 7 aa, Artificial Sequence
  Description of Artificial Sequence: Synthetic peptide
IRGSGTT

SEQ ID NO: 323 - protein, 6 aa, Artificial Sequence
  Description of Artificial Sequence: Synthetic peptide
QPISSY

SEQ ID NO: 324 - protein, 8 aa, Artificial Sequence
  Description of Artificial Sequence: Synthetic peptide
GFTFSNYD

SEQ ID NO: 325 - protein, 8 aa, Artificial Sequence
  Description of Artificial Sequence: Synthetic peptide
IRGRGGST

SEQ ID NO: 326 - protein, 6 aa, Artificial Sequence
  Description of Artificial Sequence: Synthetic peptide
QSVGHY

SEQ ID NO: 327 - protein, 11 aa, Artificial Sequence
  Description of Artificial Sequence: Synthetic peptide
QQYYNDWPPLT

SEQ ID NO: 328 - protein, 5 aa, Artificial Sequence
  Description of Artificial Sequence: Synthetic peptide
NYDMG

SEQ ID NO: 329 - protein, 7 aa, Artificial Sequence
  Description of Artificial Sequence: Synthetic peptide
GFTFSNY

SEQ ID NO: 330 - protein, 6 aa, Artificial Sequence
  Description of Artificial Sequence: Synthetic peptide
RGRGGS

SEQ ID NO: 331 - protein, 8 aa, Artificial Sequence
  Description of Artificial Sequence: Synthetic peptide
GFTFSSYD

SEQ ID NO: 332 - protein, 8 aa, Artificial Sequence
  Description of Artificial Sequence: Synthetic peptide
IRGRGGST

SEQ ID NO: 333 - protein, 5 aa, Artificial Sequence
  Description of Artificial Sequence: Synthetic peptide
SYDMG

SEQ ID NO: 334 - protein, 7 aa, Artificial Sequence
  Description of Artificial Sequence: Synthetic peptide
GFTFSSY

SEQ ID NO: 335 - protein, 17 aa, Artificial Sequence
  Description of Artificial Sequence: Synthetic peptide
  MOD_RES (3)..(3): N or Q
  MOD_RES (5)..(5): D or E
  MOD_RES (6)..(6): G or A
  MOD_RES (9)..(9): T or K
  MOD_RES (12)..(12): L or V
  MOD_RES (13)..(13): D or E
  MOD_RES (15)..(15): L or V
  MOD_RES (17)..(17): S or G
NIXYXXSSXYYXXSXKX

SEQ ID NO: 336 - protein, 11 aa, Artificial Sequence
  Description of Artificial Sequence: Synthetic peptide
  MOD_RES (1)..(1): K or R
  MOD_RES (5)..(5): D or S
  MOD_RES (6)..(6): V or I
  MOD_RES (8)..(8): T or S
  MOD_RES (10)..(10): V or L
XASQXXSXAXA

SEQ ID NO: 337 - protein, 7 aa, Artificial Sequence
  Description of Artificial Sequence: Synthetic peptide
  MOD_RES (1)..(1): S or A
  MOD_RES (4)..(4): S or Y
  MOD_RES (5)..(5): R or L
  MOD_RES (6)..(6): Y or Q
  MOD_RES (7)..(7): S or T
XASXXXX

SEQ ID NO: 338 - protein, 16 aa, Artificial Sequence
  Description of Artificial Sequence: Synthetic peptide
  MOD_RES (9)..(9): N or Q
  MOD_RES (10)..(10): Y or I
YIYYSGSTXXNPSLKS

SEQ ID NO: 339 - protein, 7 aa, Artificial Sequence
  Description of Artificial Sequence: Synthetic peptide
  MOD_RES (1)..(1): L or G
XGSNRAS

SEQ ID NO: 340 - protein, 10 aa, Artificial Sequence
  Description of Artificial Sequence: Synthetic peptide
  MOD_RES (6)..(6): S or N
GFTFSXYDMG

SEQ ID NO: 341 - protein, 16 aa, Artificial Sequence
  Description of Artificial Sequence: Synthetic peptide
  MOD_RES (12)..(12): D or E
GIRGSGTTYYAXSVKG

SEQ ID NO: 342 - protein, 17 aa, Artificial Sequence
  Description of Artificial Sequence: Synthetic peptide
  MOD_RES (13)..(13): D or E
GIRGRGGSTYYAXSVKG

SEQ ID NO: 343 - protein, 10 aa, Artificial Sequence
  Description of Artificial Sequence: Synthetic peptide
  MOD_RES (3)..(3): N or E
ENXRHSFFEY

SEQ ID NO: 344 - protein, 11 aa, Artificial Sequence
  Description of Artificial Sequence: Synthetic peptide
  MOD_RES (5)..(5): P or S
  MOD_RES (6)..(6): I or V
  MOD_RES (7)..(7): N, R, S or G
  MOD_RES (8)..(8): N, H or S
RASQXXXXYLA

SEQ ID NO: 345 - protein, 7 aa, Artificial Sequence
  Description of Artificial Sequence: Synthetic peptide
  MOD_RES (1)..(1): D or S
  MOD_RES (7)..(7): T or I
XASNRAX

SEQ ID NO: 346 - protein, 10 aa, Artificial Sequence
  Description of Artificial Sequence: Synthetic peptide
QQYYDWPPYT

SEQ ID NO: 347 - protein, 11 aa, Artificial Sequence
  Description of Artificial Sequence: Synthetic peptide
QQYYNDWPPLT

SEQ ID NO: 348 - protein, 9 aa, Artificial Sequence
  Description of Artificial Sequence: Synthetic peptide
  MOD_RES (9)..(9): A or S
GTFSDFYMX

SEQ ID NO: 349 - protein, 432 aa, Artificial Sequence
  Description of Artificial Sequence: Synthetic polypeptide
LQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQENLYFQGGGSGGSGGSGGSGGSGGSGGEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKAGSGHHHHHH

SEQ ID NO: 350 - protein, 22 aa, Homo sapiens
LQDPCSNCPAGTFCDNNRNQIC

SEQ ID NO: 351 - protein, 41 aa, Homo sapiens
SPCPPNSFSSAGGQRTCDICRQCKGVFRTRKECSSTSNAEC

SEQ ID NO: 352 - protein, 32 aa, Homo sapiens
DCTPGFHCLGAGCSMCEQDCKQGQELTKKGCK

SEQ ID NO: 353 - protein, 41 aa, Homo sapiens
DCCFGTFNDQKRGICRPWTNCSLDGKSVLVNGTKERDVVCG

SEQ ID NO: 354 - protein, 95 aa, Homo sapiens
LQDPCSNCPAGTFCDNNRNQICSPCPPNSFSSAGGQRTCDICRQCKGVFRTRKECSSTSNAECDCTPGFHCLGAGCSMCEQDCKQGQELTKKGCK

SEQ ID NO: 355 - protein, 63 aa, Homo sapiens
LQDPCSNCPAGTFCDNNRNQICSPCPPNSFSSAGGQRTCDICRQCKGVFRTRKECSSTSNAEC

SEQ ID NO: 356 - protein, 72 aa, Homo sapiens
SPCPPNSFSSAGGQRTCDICRQCKGVFRTRKECSSTSNAECDCTPGFHCLGAGCSMCEQDCKQGQELTKKGC

SEQ ID NO: 357 - protein, 73 aa, Homo sapiens
DCTPGFHCLGAGCSMCEQDCKQGQELTKKGCKDCCFGTFNDQKRGICRPWTNCSLDGKSVLVNGTKERDVVCG

SEQ ID NO: 358 - protein, 114 aa, Homo sapiens
SPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCG

SEQ ID NO: 359 - protein, 431 aa, Artificial Sequence
  Description of Artificial Sequence: Synthetic polypeptide
QDLCSNCPAGTFCDNNRSQICSPCPPNSFSSAGGQRTCDICRQCKGVFKTRKECSSTSNAECDCISGYHCLGAECSMCEQDCKQGQELTKKGCKDCCFGTFNDQKRGICRPWTNCSLDGKSVLVNGTKERDVVCGPSPADLSPGASSATPPAPAREPGHSPQENLYFQGGGSGGSGGSGGSGGSGGSGGEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKAGSGHHHHHH

SEQ ID NO: 360 - protein, 21 aa, Mus musculus
LQDPCDNCQPGTFCRKYNPVC

SEQ ID NO: 361 - protein, 41 aa, Mus musculus
SPCPPSTFSSIGGQPNCNICRVCAGYFRFKKFCSSTHNAEC

SEQ ID NO: 362 - protein, 32 aa, Mus musculus
DCIEGFHCLGPQCTRCEKDCRPGQELTKQGCK

SEQ ID NO: 363 - protein, 42 aa, Mus musculus
DCSLGTFNDQNGTGVCRPWTNCSLDGRSVLKTGTTEKDVVCG

SEQ ID NO: 364 - DNA, 45 bp, Artificial Sequence
  Description of Artificial Sequence: Synthetic primer
ctaatacgactcactatagggcaagcagtggtatcaacgcagagt

SEQ ID NO: 365 - DNA, 26 bp, Artificial Sequence
  Description of Artificial Sequence: Synthetic primer
ggggccagtggatagacagatggggg

SEQ ID NO: 366 - DNA, 45 bp, Artificial Sequence; identical to SEQ ID NO: 364
  Description of Artificial Sequence: Synthetic primer

SEQ ID NO: 367 - DNA, 26 bp, Artificial Sequence
  Description of Artificial Sequence: Synthetic primer
ctgctcactggatggtgggaagatgg

SEQ ID NO: 368 - DNA, 46 bp, Artificial Sequence
  Description of Artificial Sequence: Synthetic primer
ttaaacggatctctagcgaattcaagcagtggtatcaacgcagagt

SEQ ID NO: 369 - DNA, 52 bp, Artificial Sequence
  Description of Artificial Sequence: Synthetic primer
tggaggagggtgctagcggaaagacagatgggcctttcgttgaggctgagga

SEQ ID NO: 370 - DNA, 46 bp, Artificial Sequence; identical to SEQ ID NO: 368
  Description of Artificial Sequence: Synthetic primer

SEQ ID NO: 371 - protein, 121 aa, Artificial Sequence [sequence omitted]

SEQ ID NO: 372 - protein, 109 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFCGGTKVEIK

SEQ ID NO: 373 - protein, 116 aa, Artificial Sequence
  Description of Artificial Sequence: Synthetic polypeptide
EVQLVQSGAEVKKPGESLRISCKGSGYSFSTYWISWVRQMPGKGLEWMGKIYPGDSYTNYSPSFQGQVTISADKSISTAYLQWSSLKASDTAMYYCARGYGIFDYWGQGTLVTVSS

SEQ ID NO: 374 - protein, 108 aa, Artificial Sequence
  Description of Artificial Sequence: Synthetic polypeptide
SYELTQPPSVSVSPGQTASITCSGDNIGDQYAHWYQQKPGQSPVLVIYQDKNRPSGIPERFSGSNSGNTATLTISGTQAMDEADYYCATYTGFGSLAVFGGGTKLTVL

SEQ ID NO: 375 - protein, 118 aa, Artificial Sequence
  Description of Artificial Sequence: Synthetic polypeptide
QVQLVQSGAEVKKPGASVKVSCKASGYTLTNYPMHWVRQAPGQRPEWMGWSNAGNGNTKYSQEFQDRVTITRDTSASTAYMELSSLRSEDMAVYYCTREGVTGGFDIWGQGTMVTVSS

SEQ ID NO: 376 - protein, 111 aa, Artificial Sequence
  Description of Artificial Sequence: Synthetic polypeptide
DIVMTQSPLSLPVTPGEPASISCRSSQSLLHSIGYNYLDWYLQKPGQSPQLLIFLGSNRASGVPDRFSGSGSGTDFTLKISRVEAEDVGVYYCMQALQTVTFGQGTRLEIK

SEQ ID NO: 377 - protein, 118 aa, Artificial Sequence
  Description of Artificial Sequence: Synthetic polypeptide
QVQLVQSGADVKKPGASVRVSCKASGYTFTSYPIHWVRQAPGHRLEWMGWSNAGIGNAKYSQEFQGRVTITRDTSASTAYMDLSSLTSEDLAVYYCAREGVAGAFDIWGQGTMVTVSA

SEQ ID NO: 378 - protein, 112 aa, Artificial Sequence
  Description of Artificial Sequence: Synthetic polypeptide
DIVMTQSPLSLPVTPGEPASISCRSSQNLLHSNGYNYLDWYLHKPGQSPQLLIYLGSIRASGVPDRFSGSESGTDFTLKISRVEAEDVGIYYCMQPLQIPYTFGQGTKLELK

SEQ ID NO: 379 - protein, 121 aa, Artificial Sequence
  Description of Artificial Sequence: Synthetic polypeptide
DVQLQESGPGLVKPSQSLSLTCTVTGYSITSDYGWNWIRQFPGNKVEWMGYISYSGSTSYNPSLKSRISITRDTSKNQFFLQLKSVTTEDTATYYCARSDPYYGISWFAYWGQGPLVTVSA

SEQ ID NO: 380 - protein, 107 aa, Artificial Sequence
  Description of Artificial Sequence: Synthetic polypeptide
DIQMTQTTSSLSASLGDRVTISCRASQDISNFLNWYQQKPDGTVKLLIYYTSRLHSGVPSRFSGSGSGTDYSLTISNLEQEDIATYFCQQSHTLPWTFGGGTKLEIK

SEQ ID NO: 381 - protein, 119 aa, Artificial Sequence
  Description of Artificial Sequence: Synthetic polypeptide
DVQLQESGPGLVKPSQSLSLTCTVTGYSITSDYVWNWIRQFPGNKLEWMGYISYSGGTRYNPSLKSRISITRDTSENQFFLQLDSVTTEDTATFYCARSGNWDWYFDAWGTGTTVTVSS

SEQ ID NO: 382 - protein, 107 aa, Artificial Sequence
  Description of Artificial Sequence: Synthetic polypeptide
DIQMTQTTSSLSASLGDRVTISCRPSQDISNYLDWYQQKPDGTVKLLIYSTSRLPSGVPSRFSGSGSGTDYSLTISNMEQEDIATYFCQQGNTFPPTFGGGTKLEIK

SEQ ID NO: 383 - protein, 117 aa, Artificial Sequence
  Description of Artificial Sequence: Synthetic polypeptide
DVQLQESGPDLVKPSQSLSLTCTVTGYSITSGFNWHWIRQFPGNKLEWMGYIHNSGSTNYNPFLKSRISITRDTSKNQFFLQLNSVTTEDTATYYCARGALGTMDYWGQGTSVTVSS

SEQ ID NO: 384 - protein, 111 aa, Artificial Sequence
  Description of Artificial Sequence: Synthetic polypeptide
DIVLTQSPASLAVSLGQRATISCEASQSLDYDGDSYMHWFQQKPGQPPKLLIYVASNLESGIPARFSGSGSGTDFTLNIHPVEEEDAATYYCQQSNEDPWTFGGGTKLEIK

SEQ ID NO: 385 - protein, 119 aa, Artificial Sequence
  Description of Artificial Sequence: Synthetic polypeptide
DVQLQESGPGLLKPSQSLSLTCTVTGYSITSDYVWSWIRQFPGNKLEWMGYINYSGGTSYNPSLKSRISITRDTSKNQFFLQLNSVTTEDTATYYCTRSGNWDWYFDVWGTGTTVTVSS

SEQ ID NO: 386 - protein, 107 aa, Artificial Sequence
  Description of Artificial Sequence: Synthetic polypeptide
DIQMTQTTSSLSASLGDRVTISCRASQDIRNNLNWFQQKPDGTVKLLIYYTSRLHSGLPSRFSGSGSGTDYSLTISNLEQEDFATYFCQQGNTLPPTFGGGTKLEIK

SEQ ID NO: 387 - protein, 117 aa, Artificial Sequence
  Description of Artificial Sequence: Synthetic polypeptide
DVQLQESGPDLVKPSQSLSLTCTVTGYSITSGYNWHWIRQFPGNKLEWMGYIHYSGSTNYNPSLKSRISITRDTSKNQFFLQLNSVTTEDTATYYCARGALGAMDYWGQGTSVTVSS

SEQ ID NO: 388 - protein, 111 aa, Artificial Sequence
  Description of Artificial Sequence: Synthetic polypeptide
DIVLTQSPASLAVSPGQRATISCKASQSVDYDGDSYMNWYQQKPGQPPKLLIYVASNVESGIPARFSGSGSGTDFTLNIHPVEEEDAATYYCQQSNEDPWTFGGGTKLEIK

SEQ ID NO: 389 - protein, 119 aa, Artificial Sequence
  Description of Artificial Sequence: Synthetic polypeptide
QVQLKQSGPGLVQPSQSLSITCTVSGFSLTSHGVHWVRQSPGKGLEWLGVIWSGGYTDYNAAFISRLSISTDNSKSHIFFKMNSLQADDTAIYYCARNGASYYYAMDYWGQGTSVTVSS

SEQ ID NO: 390 - protein, 112 aa, Artificial Sequence
  Description of Artificial Sequence: Synthetic polypeptide
DIVMTQAAFSNPVTLGISASISCRSSKSLLHSNGITYLYWYLQKPGQSPQLLIYQMSNLASGVPDRFSSSGSGTDFTLRISRVEAEDVGVYYCAQNLELPLTFGAGTKLELK

SEQ ID NO: 391 - protein, 115 aa, Artificial Sequence
  Description of Artificial Sequence: Synthetic polypeptide
EVQLQQSGAELVKPGASVKLSCTASGFNIKDTYIHWVKQRPEQGLEWIGRIDPANGNTIYASKFQGKATITADTSSNTAYMQLSSLTSGDTAVYYCVRLDLLNYWGQGTTLTVSS

SEQ ID NO: 392 - protein, 107 aa, Artificial Sequence
  Description of Artificial Sequence: Synthetic polypeptide
DIKMTQSPSSMYASLGERVTITCKASQDIATYLSWFQQKPGKSPKTLIYRTNGLLDGVPSRFSGSGSGQDYSLTISSLEYEDMGIYYCLQYDEFPFTFGGGTKLEIK

SEQ ID NO: 393 - protein, 116 aa, Artificial Sequence
  Description of Artificial Sequence: Synthetic polypeptide
QVQLQQPGAELVKPGASVKLSCKASGYTFTNFWINWVKQRPGQALEWIGNIYPGNDNTNYNGNFKTKATLTVDRSSSTAYMHLSSLTSKDSAVYYCARGQLGLDYWGQGTTLTVSS

SEQ ID NO: 394 - protein, 107 aa, Artificial Sequence
  Description of Artificial Sequence: Synthetic polypeptide
DILLTQSPAILSVSPGERVSFSCRASQNIGTTIHWYHQRTNGSPRLLIKFASESISGIPSRFSGSGSGTDFTLSINSVESEDFADYYCQQSNSWPFTFGSGTKLEIK

SEQ ID NO: 395 - protein, 116 aa, Artificial Sequence
  Description of Artificial Sequence: Synthetic polypeptide
QVQLQQPGAELVKPGASVKLSCKASGYTFTNFWINWVKQRPGQALEWIGNIYPGNDNTNYNGNFKSKATLTVDRSSSTAYMHLSSLTSKDSAVYYCARGQLGLDYWGQGTTLTVSS

SEQ ID NO: 396 - protein, 107 aa, Artificial Sequence
  Description of Artificial Sequence: Synthetic polypeptide
DILLTQSPAILSVSPGERVSFSCRASQNIGTAIHWYHQRTNGSPRLLIKFASESISGIPSRFSGSGSGTDFTLSINSVESEDFADYYCQQSNSWPFTFGSGTKLEIK

SEQ ID NO: 397 - protein, 114 aa, Artificial Sequence
  Description of Artificial Sequence: Synthetic polypeptide
DVQLVESGGDLVQPGGSRKLSCAASGFTFSSFGMHWVRQAPERGLEWVAYISSGSSTIYYADTVKGRFIISRDNPKNTLFLQMTSLRSEDTAMYYCARDWVDYWGQGTSVTVSS

SEQ ID NO: 398 - protein, 112 aa, Artificial Sequence
  Description of Artificial Sequence: Synthetic polypeptide
DVLMTQTPLSLPVSLGDQASISCRSSQNIVHGNGNTYLEWYLQKPGQSPKLLIYQVSNRFSGVPDRFSGSGSGTDFTLKISRVEAEDLGVYYCFQGSHVPRTFGGGTKLEIK

SEQ ID NO: 399 - protein, 114 aa, Artificial Sequence
  Description of Artificial Sequence: Synthetic polypeptide
DVQLVESGGGLVQPGGSRKLSCAASGFSFSSFGMHWVRQAPEKGLEWVAYISSGSSTIYYADTVKGRFTISRDNPKNTLFLQMTSLRSEDTAMYYCVRDWTDYWGQGTTLTVST

SEQ ID NO: 400 - protein, 106 aa, Artificial Sequence
  Description of Artificial Sequence: Synthetic polypeptide
QIVLTQSPAIMSASLGEEITLTCSATSSVSYMHWSQQKSGTSPKLLIYTTSNLASGVPSRFSGSGSGTFYSLTISSVEAEDAADYYCHQWTTYPWTFGGGTKLEIK

SEQ ID NO: 401 - protein, 115 aa, Artificial Sequence
  Description of Artificial Sequence: Synthetic polypeptide
EVQLQESGPSLVKPSQTLSLTCSVTGDSITSGYWNWNRKFPGNKFEYMGYISYSDSAYYNPSLKSRISITRDTSKNQYYLQLNSVTTEDTATYYCTRWGIPFAFWGQGTLVTVSA

SEQ ID NO: 402 - protein, 107 aa, Artificial Sequence
  Description of Artificial Sequence: Synthetic polypeptide
DIKMTQSPSSMYASLGERVTITCKASQDIDSYLYWFQQKPGKSPETLIYHANRLVDGVPSRFSGSGSGQDYSLTISSLEYEDMGIYYCLQYDEFPYTFGGGTKLEIK

SEQ ID NO: 403 - protein, 117 aa, Artificial Sequence
  Description of Artificial Sequence: Synthetic polypeptide
QVQLQQSGAELTRPGASVKLSCKASGYTFTNYWIQWIKQRPGQGLEWIGTIYPENGDTRYTQKFKGKATLTADKSSSTAYMQLSSLASEDSAVYYCARGLLEGAHYWGQGTTLTVSS

SEQ ID NO: 404 - protein, 107 aa, Artificial Sequence
  Description of Artificial Sequence: Synthetic polypeptide
DILLTQSPAILSVSPGERVSFSCRASQSIGASIHWYQQRTNGSPRLLIKFSSESISGIPSRFSGSGSGTDFTLTINSVESEDIADYYCQQTNSWPTAFGGGTKLEMK

SEQ ID NO: 405 - protein, 120 aa, Artificial Sequence
  Description of Artificial Sequence: Synthetic polypeptide
QVQLQQPGTEFVKPGASVKLSCKASDYTFTSHWMHWVKQRPGQGLEWIGEIDPSDSYTNYIQKFKGKATLTVDKSSSTAYMQLSSLTSEDSAVYYCARGDYYGTRYFDVWGAGTTVIVSS

SEQ ID NO: 406 - protein, 113 aa, Artificial Sequence
  Description of Artificial Sequence: Synthetic polypeptide
DIVMTQSPSSLSVSAGEKVTMSCKSGQNLFNSGNQKNYLAWYQQKPGQPPRLLIYGASTRESGVPDRFTGSGSGTDFTLTISSVQAEDLAVYYCQNDQSYPPTFGAGTKLELK

SEQ ID NO: 407 - protein, 118 aa, Artificial Sequence
  Description of Artificial Sequence: Synthetic polypeptide
QVQLQQSGAELMKPGSSVKLSCKAPGYKFTDYWIEWVKQRPGHGLDWIGNILPGTINTNSNENFKGKATFTADTSSNTAYMQLSSLTSEDSAVYYCARRSLEYYFDYWGQGTTLTVSS

SEQ ID NO: 408 - protein, 111 aa, Artificial Sequence
  Description of Artificial Sequence: Synthetic polypeptide
DIVVTQSPASLAVSLGQRATISCRASQSVSTSRYSYMHWYQQKPGQPPRLLINYASNLESGVPARFSGSGSGTDFTLNIHPVEEEDTATYYCQHTWEIPWTFGGGTKLEIK

SEQ ID NO: 409 - protein, 120 aa, Artificial Sequence
  Description of Artificial Sequence: Synthetic polypeptide
QVQLQESGPGLVKPSETLSLNCTVSGGSISNYYWSWIRQPAGKGLEWIGRIYTSGNTNYNPSLKSRVTMSVDTSKNQFSLKLTSVTAADTAVYYCARDGNWNYADAFDIWGQGTMVTVSS

SEQ ID NO: 410 - protein, 107 aa, Artificial Sequence
  Description of Artificial Sequence: Synthetic polypeptide
DIQMTQSPSSVSASVGDRVTITCRASQGISSWLAWFQQIPGKAPKLLIYTASGLQSGVPSRFSGSGSGTDFTLTISSLQPEDFATYYCQQTNSFPFTFGPGTKVDIK

SEQ ID NO: 411 - protein, 124 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSNWYNDYAVSVESRITIKPDTSKNQFSLQLNSVTPEDTAVYYCARMDSGTYLDAFDIWGQGTMVTVSS

SEQ ID NO: 412 - protein, 108 aa, Artificial Sequence
  Description of Artificial Sequence: Synthetic polypeptide
EIVMTQSPATLSVSPGERATLSCRASQSVGRNLAWYQQKPGQTPRLLIYGASTRATGIPAIFSGSGSGTEFTLTISSLQSEDFAVYYCQQYNYWPPFTFAQGTKLEIK

SEQ ID NO: 413 - protein, 118 aa, Artificial Sequence
  Description of Artificial Sequence: Synthetic polypeptide
QVQLVQSGAEVKKPGASVKVSCKASGYTFTNYPIHWVRQAPGQRLEWMGWSNAGNGNTKYSPEFQDRVTITRDTSASTVYMELSSLRSEDMSVYYCAREGVTGAFDIWGQGTMVTVSS

SEQ ID NO: 414 - protein, 112 aa, Artificial Sequence
  Description of Artificial Sequence: Synthetic polypeptide
DIVMTQSPLSLPVTPGEPASISCRSSQSLLHSIGYNYLDWYLQKPGQSPQLLIYLGSYRASGVPDRFSGSGSGTDFTLKISRVEAEDVGVYYCMQALQTPLTFGGGTKVEIK

SEQ ID NO: 415 - protein, 118 aa, Artificial Sequence
  Description of Artificial Sequence: Synthetic polypeptide
QVQLVQSGAEVKKPGASVKVSCKASGYIFTNYPMHWVRQAPGQRLEWMGWSNAGIGNTKYSQDFQGRVTITRDTSANTSYMELSSLRSEDMAVYYCAREGVTGAFDYWGQGTLVTVSS

SEQ ID NO: 416 - protein, 112 aa, Artificial Sequence
  Description of Artificial Sequence: Synthetic polypeptide
DIVMTQSPLSLPVTPGEPASISCRSSQSLLHSNGFNYLDWYLQKPGQSPQLLIFLGSIRASGVPDRFSGSESGTDFTLKISRVEADDVGIYYCMQPLQIPYTFGQGTKLEIK

SEQ ID NO: 417 - protein, 118 aa, Artificial Sequence
  Description of Artificial Sequence: Synthetic polypeptide
QVQLAQSGAEVKKPGASVKVSCKASGYTFSSFPMHWVRQAPGQRLEWMGWSNAGIGNTKYSQEFQGRVTITRDTSASTAYMELSSLRSEDMAVYYCAREGLTGAFDYWGQGTLVTVSS

SEQ ID NO: 418 - protein, 112 aa, Artificial Sequence
  Description of Artificial Sequence: Synthetic polypeptide
DIVMTQSPLSLPVTPGEPASISCRSSQSLLHSNGYNYLGWHLQKPGQSPQLLIYLGSYRASGVPDRFSGSGSGTDFTLKISRVEAEDVGVYYCMQPLQIPLTFGGGTKVEIK

SEQ ID NO: 419 - protein, 118 aa, Artificial Sequence; identical to SEQ ID NO: 417
  Description of Artificial Sequence: Synthetic polypeptide

SEQ ID NO: 420 - protein, 112 aa, Artificial Sequence
  Description of Artificial Sequence: Synthetic polypeptide
DIVMTQSPLSLPVTPGEPASISCRSSQSLLHSNGYNYLGWYLQKPGQSPQLLIYLGSYRASGVPDRFSGSGSGTDFTLKISRVEAEDVGVYYCMQPLQIPLTFGGGTKVEIK

SEQ ID NO: 421 - protein, 118 aa, Artificial Sequence; identical to SEQ ID NO: 70
  Description of Artificial Sequence: Synthetic polypeptide

SEQ ID NO: 422 - protein, 112 aa, Artificial Sequence; identical to SEQ ID NO: 75
  Description of Artificial Sequence: Synthetic polypeptide

SEQ ID NO: 423 - protein, 124 aa, Artificial Sequence
  Description of Artificial Sequence: Synthetic polypeptide
QVTLKESGPVLVKPTETLTLTCTVSGFSLSNARVGVSWIRQPPGKALESLVHIFSNDEKFFSTSLKSRLTISKDTSKSQVVLTMTNMVPVDTATYYCARNGGFGVIIHDAFDIWGQGTMVTVSS

SEQ ID NO: 424 - protein, 107 aa, Artificial Sequence
  Description of Artificial Sequence: Synthetic polypeptide
DIQLTQSPSFLSASVGDRVTITCRASQGISSYLAWYQQKPGKAPKLLIFAASTLQNGVPSRFSGSGSGTEFTLTISSLQPEDFATYYCQQLNNYPRTFGQGTKVEIK

SEQ ID NO: 425 - protein, 122 aa, Artificial Sequence
  Description of Artificial Sequence: Synthetic polypeptide
EVQLLESGGGLIQPGGSLRLSCAASGFTFSSYAMRWVRQAPGKGLEWVSDISGSGGSTFYADSVKGRFTISRDNSKNTLFLQMNSLRAEDTAVYYCAKEGGTHYYFFGMDVWGQGTTVTVSS

SEQ ID NO: 426 - protein, 107 aa, Artificial Sequence
  Description of Artificial Sequence: Synthetic polypeptide
DIQLTQSPSFLSASVGDRVTITCRASQGISSYLAWYQQKPGKAPKLLIYAASSLQNGVPSGFSGSGSGTEFTLTISSLQPEDFATYYCQQFNSYPLTFGGGTKVEIK

SEQ ID NO: 427 - protein, 118 aa, Artificial Sequence
  Description of Artificial Sequence: Synthetic polypeptide
QVQLVQSGAEVKKPGASVKVSCKTSGYTFTSYPMHWVRQAPGQRLEWMGWSNAGNGNTKYSQEFQGRVTLTRDTSASTAFMELSSLRSEDMAVYYCAREGLTGAFDYWGQGTLVTVSS

SEQ ID NO: 428 - protein, 112 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQPLQTPYTFGQGTKLEIK

SEQ ID NO: 429 - protein, 116 aa, Artificial Sequence; identical to SEQ ID NO: 393
  Description of Artificial Sequence: Synthetic polypeptide

SEQ ID NO: 430 - protein, 107 aa, Artificial Sequence; identical to SEQ ID NO: 394
  Description of Artificial Sequence: Synthetic polypeptide

SEQ ID NO: 431 - protein, 116 aa, Artificial Sequence
  Description of Artificial Sequence: Synthetic polypeptide
QVQLQQPGAELVKPGASVKLSCKASGYTFTNFWINWVKQRPGQGLEWIGNIYPGNTGTNYNERFKTKATLTVDISSSTAYMRLSSLTSEDSAVYYCARGQLGLDYWGQGTTLTVSS

SEQ ID NO: 432 - protein, 107 aa, Artificial Sequence
  Description of Artificial Sequence: Synthetic polypeptide
DILLTQSPAILSVSPGERVSFSCRASQIIGTTIQWYQQRTNGSPRLLIKYASESLSGIPSRFSGSGSGTDFTLSINNVESEDIADYYCQQSHSWPFTFGSGTKLEIK

SEQ ID NO: 433 - protein, 114 aa, Artificial Sequence; identical to SEQ ID NO: 397
  Description of Artificial Sequence: Synthetic polypeptide

SEQ ID NO: 434 - protein, 106 aa, Artificial Sequence
  Description of Artificial Sequence: Synthetic polypeptide
QIVLTQSPAIMSASPGEKVTITCSASSSVNYIHWFQQKPGTSPKLWIYSTSNLASGVPARFSGRGSGTSYSLTISRMEAEDAATYYCLQGSSYPWTFGGGTKLEIK

SEQ ID NO: 435 - protein, 116 aa, Artificial Sequence
  Description of Artificial Sequence: Synthetic polypeptide
DVQLQESGPGLVKPSQSLSLTCTVTGYSITSDYAWNWIRQFPGNRLEWMGYISYSGSTSYNPSLKSRISITRDTSKNQFFLQLNSVTTEDTATYFCARWGYVLDYWGQGTSVTVSS

SEQ ID NO: 436 - protein, 107 aa, Artificial Sequence
  Description of Artificial Sequence: Synthetic polypeptide
DIVMTQSHKFMSTSEGDRVSITCKASQDVSTAVAWYQQKPGQSPKLLIYWASTRHTGVPDRFRGSGSGTDYTLTISSVQAEDLALYFCQQHYFTPYTFGGGTKLEIK

SEQ ID NO: 437 - protein, 117 aa, Artificial Sequence
  Description of Artificial Sequence: Synthetic polypeptide
QVQLQQSGAELMKPGASVKISCKATGYTFSSYWLEWIKQRPGHGLEWIGEILPGSGVSNYNEKFKGKATFTANTSSNTAYMQLSSLTSEDSAVYYCARLGLAWFAYWGQGTLVTVSA

SEQ ID NO: 438 - protein, 112 aa, Artificial Sequence; identical to SEQ ID NO: 398
  Description of Artificial Sequence: Synthetic polypeptide

SEQ ID NO: 439 - protein, 121 aa, Artificial Sequence
  Description of Artificial Sequence: Synthetic polypeptide
EVQLQESGPSLVKPSQTLSLTCSVTGDSITSGYWNWIRKFPGNKLEFMGYITYSGSTYYNPSLKSRISITRDTSRNQFYLQVNSVTTEDTATYFCTRYYYYGSTYYAMDYWGQGTSVTVSS

SEQ ID NO: 440 - protein, 111 aa, Artificial Sequence
  Description of Artificial Sequence: Synthetic polypeptide
NIVLTQSPASLAVSLGQRATISCRVSESVDSYGNSFMHWFQQKPGQSPKLLIYLASNLESGVPARFSGSGSRTDFTLTIDPVEADDAATYYCQQNIEDPPTFGGGTKLEIK

SEQ ID NO: 441 - protein, 118 aa, Artificial Sequence
  Description of Artificial Sequence: Synthetic polypeptide
QVQLVQSGAEVKKPGASVKVSCKASGYTLTNFPMHWVRQAPGQRLEWMGWTNAGNGNTKYSQELQGRVTMTRDTSASIAYMELSSLRSEDMGVYYCAREGLTGAFDYWGQGTLVTVSS

SEQ ID NO: 442 - protein, 112 aa, Artificial Sequence
  Description of Artificial Sequence: Synthetic polypeptide
DIVMTQSPLSLPVTPGDPASISCRSSQSLLHSNGYNYLDWYLQKPGQSPQLLIYLGSNRASGVPDRFSGSGSGTDFTLKISRVEAEDVGVYYCMQPLQSPYTFGQGTKLEIK

SEQ ID NO: 443 - protein, 118 aa, Artificial Sequence
  Description of Artificial Sequence: Synthetic polypeptide
QVQLVQSGAEVKKPGASVKVSCKASGYTFTNYPMHWVRQAPGQRLEWMGWSNAGSGNTKYSQDFQGRVSITRDTSASTAYMELSSLKSEDMAIYYCAREGVAGAFDIWGQGTVVTVSS

SEQ ID NO: 444 - protein, 112 aa, Artificial Sequence
  Description of Artificial Sequence: Synthetic polypeptide
DIVMTQSPLSLPVTPGEPASISCRSSQRLLHSNGFNYLGWYLQKPGQSPQLLIYLGSHRASGVPDRFSGSGSGTDFTLKISRVEAEDVGVYYCMQPLQIPYTFGQGTKLEIK

SEQ ID NO: 445 - protein, 118 aa, Artificial Sequence
  Description of Artificial Sequence: Synthetic polypeptide
QVQLVQSGAEVKKPGASVKVSCKASGYTFTTYPMHWVRQAPGQRLEWMGWSNAGIGNTKYSQEFQDRITISRDTSASTVYMELSSLRSEDMAVYYCAREGVAGGFDIWGQGTMVTVSS

SEQ ID NO: 446 - protein, 112 aa, Artificial Sequence
  Description of Artificial Sequence: Synthetic polypeptide
DIVMTQSPLSLPVTPGEPASISCRSSQSLLHSNGYNYLNWYLQKPGQSPQLLIYLGSIRASGVPDRFSGSESGTDFTLKISRVEAEDVGVYYCMQPLQIPYTFGQGTKLEIK

SEQ ID NO: 447 - protein, 116 aa, Artificial Sequence; identical to SEQ ID NO: 393
  Description of Artificial Sequence: Synthetic polypeptide

SEQ ID NO: 448 - protein, 107 aa, Artificial Sequence; identical to SEQ ID NO: 394
  Description of Artificial Sequence: Synthetic polypeptide

SEQ ID NO: 449 - protein, 114 aa, Artificial Sequence
  Description of Artificial Sequence: Synthetic polypeptide
EVQLQQSGPELVKPGASVKMSCKASGYTFTYYVMHWVKQKPGQGLEWIGYINPYNDGTKYNEKFKGKATLTSDKSSSTAYMELSSLTSEDSAVYYCAPGSVDYWGQGTTLTVSS

SEQ ID NO: 450 - protein, 107 aa, Artificial Sequence
  Description of Artificial Sequence: Synthetic polypeptide
DIVMTQSQKFMSTSVGDRVSITCKASQNVGTSVAWYQQKSGHSPKLLIYSASNRNTGVPDRFTGSGSGTDFTLTISNMQSEDLADYFCQQYSTYPLTFGSGTKLEIK

SEQ ID NO: 451 - protein, 119 aa, Artificial Sequence
  Description of Artificial Sequence: Synthetic polypeptide
QVQLKQSGPGLVPPSQSLSITCTVSGFSLSSYGVHWVRQSPGKGLEWLGVIWSGGNTDFNAAFVSRLSISTEISESQVFFRMNSLQADDTAIYYCARNGPQYYFAMDYWGQGTSVTVSS

SEQ ID NO: 452 - protein, 111 aa, Artificial Sequence
  Description of Artificial Sequence: Synthetic polypeptide
DIVLTQSPASLTVSLGQRATISCRANKSVSTSGYSYMHWHQQKPGQPPKLLIYLASNLESGVPARFSGSGSGTDFTLNIHPVEEEDAATYYCQHSRELPLTFGAGTKLELK

SEQ ID NO: 453 - protein, 119 aa, Artificial Sequence; identical to SEQ ID NO: 10
  Description of Artificial Sequence: Synthetic polypeptide

SEQ ID NO: 454 - protein, 107 aa, Artificial Sequence; identical to SEQ ID NO: 15
  Description of Artificial Sequence: Synthetic polypeptide

SEQ ID NO: 455 - protein, 119 aa, Artificial Sequence; identical to SEQ ID NO: 10
  Description of Artificial Sequence: Synthetic polypeptide

SEQ ID NO: 456 - protein, 107 aa, Artificial Sequence; identical to SEQ ID NO: 15
  Description of Artificial Sequence: Synthetic polypeptide

SEQ ID NO: 457 - protein, 120 aa, Artificial Sequence
  Description of Artificial Sequence: Synthetic polypeptide
QVQLQQSGAELVRPGASVKISCKAFGYTFTNHHINWVKQRPGQGLDWIGYINPYNDYSGYNQKFKGRATLTVDKSSNTAYMELSSLTSEDSAVYYCATPGTWEGYYFDYWGQGTTLTVSS

SEQ ID NO: 458 - protein, 112 aa, Artificial Sequence
  Description of Artificial Sequence: Synthetic polypeptide
DVVMTQTPLSLPVSLGDQASISCRSSQSLVHSNGNTYLEWYLQKPGQSPKVLIYMVSNRFSGVPDRFSGSGSGTDFTLKISRVEAEDLGVYYCFQGSHIPLTFGAGTKLELK

SEQ ID NO: 459 - protein, 120 aa, Artificial Sequence
  Description of Artificial Sequence: Synthetic polypeptide
QVQLQQSGPQLIRPGASVKISCKASGYSFTGYWIHWVKQRPGQGLEWIGMIDPSDSETRLNQKFKDKATLTVDKSSTTAYMQLSSPTSEDSAVFYCARYRNYGYDGFAHWGQGTLVTVSA

SEQ ID NO: 460 - protein, 113 aa, Artificial Sequence
  Description of Artificial Sequence: Synthetic polypeptide
DIVMTQSPSSLTVTAGEKVTMSCKSSQSLLNSGNEKNYLAWYQQKPGQPPKLLIYWASTRESGVPDRFTGSGSGTDFTLTISSVQTEDLAVYHCQNDYSLPLTFGAGTKLELK

SEQ ID NO: 461 - protein, 120 aa, Artificial Sequence; identical to SEQ ID NO: 459
  Description of Artificial Sequence: Synthetic polypeptide

SEQ ID NO: 462 - protein, 113 aa, Artificial Sequence; identical to SEQ ID NO: 460
  Description of Artificial Sequence: Synthetic polypeptide

SEQ ID NO: 463 - protein, 120 aa, Artificial Sequence; identical to SEQ ID NO: 459
  Description of Artificial Sequence: Synthetic polypeptide

SEQ ID NO: 464 - protein, 113 aa, Artificial Sequence; identical to SEQ ID NO: 460
  Description of Artificial Sequence: Synthetic polypeptide

SEQ ID NO: 465 - DNA, 321 bp, Artificial Sequence
  Description of Artificial Sequence: Synthetic polynucleotide
gacatcgtgatgacccagagccacaagttcatgagcaccagcgtgggcgaccgcgtgagcatcacctgcaaggccagccaggacgtgagcaccgccgtggcctggtaccagcagaagccaggccagagcccaaagctgctgatctacagcgccagctaccgctacaccggcgtgccagaccgcttcaccggcagcggcagcggcaccgacttcaccttcaccatcagcagcgtgcaggccgaggacctggccgtgtactactgccagcagcactacagcaacccatggaccttcggcggcggcaccaagctggagatcaag

SEQ ID NO: 466 - DNA, 357 bp, Artificial Sequence
  Description of Artificial Sequence: Synthetic polynucleotide
gaggtgaagctggtggagagcgagggcggcctggtgcagccaggcagcagcatgaagctgagctgcaccgccagcggcttcaccttcagcgacttctacatggcctgggtgcgccaggtgccagagaagggcctggagtgggtggccaacatcaactacgacggcagcagcacctactacctggacagcctgaagagccgcttcatcatcagccgcgacaacgcccgcaacatcctgtacctgcagatgagcagcctgaagagcgaggacaccgccacctactactgcgcccgcgagggcgacgagggctggtacttcgacgtgtggggcgccggcaccaccgtgaccgtgagcagc

SEQ ID NO: 467 - DNA, 50 bp, Artificial Sequence
  Description of Artificial Sequence: Synthetic oligonucleotide
ggtgccgttctatagccatagcgaggtgaagctggtggagagcgagggcg

SEQ ID NO: 468 - DNA, 51 bp, Artificial Sequence
  Description of Artificial Sequence: Synthetic oligonucleotide
ggaagaccgatgggcccttggtggaggcgctgctcacggtcacggtggtgc

SEQ ID NO: 469 - DNA, 49 bp, Artificial Sequence
  Description of Artificial Sequence: Synthetic oligonucleotide
ggtcgttccattttactcccactccgacatcgtgatgacccagagccac

SEQ ID NO: 470 - DNA, 53 bp, Artificial Sequence
  Description of Artificial Sequence: Synthetic oligonucleotide
cagatggtgcagccacagttcgcttgatctccagcttggtgccgccgccgaag

SEQ ID NO: 471 - DNA, 321 bp, Artificial Sequence
  Description of Artificial Sequence: Synthetic polynucleotide
gacatccagatgacccagagcccaagcagcctgagcgccagcgtgggcgaccgcgtgaccatcacctgcaaggccagccaggacgtgagcaccgccgtggcctggtaccagcagaagccaggcaaggccccaaagctgctgatctacagcgccagctaccgctacaccggcgtgccaagccgcttcagcggcagcggcagcggcaccgacttcaccctgaccatcagcagcctgcagccagaggacttcgccacctactactgccagcagcactacagcaacccatggaccttcggccagggcaccaagctggagatcaag

SEQ ID NO: 472 - DNA, 357 bp, Artificial Sequence
  Description of Artificial Sequence: Synthetic polynucleotide
gaggtgcagctggtggagagcggcggcggcctggtgcagccaggcggcagcctgcgcctgagctgcgccgccagcggcttcaccttcagcgacttctacatggcctgggtgcgccaggccccaggcaagggcctggagtgggtggccaacatcaactacgacggcagcagcacctactacctggacagcctgaagagccgcttcaccatcagccgcgacaacgccaagaacagcctgtacctgcagatgaacagcctgcgcgccgaggacaccgccgtgtactactgcgcccgcgagggcgacgagggctggtacttcgacgtgtggggccagggcaccaccgtgaccgtgagcagc

SEQ ID NO: 473 - DNA, 44 bp, Artificial Sequence
  Description of Artificial Sequence: Synthetic oligonucleotide
gccgttctatagccatagcgaggtgcagctggtggagagcggag

SEQ ID NO: 474 - DNA, 57 bp, Artificial Sequence
  Description of Artificial Sequence: Synthetic oligonucleotide
gtgtggggacagggcacaactgtgacagtgagctccgcctccaccaagggcccatcg

SEQ ID NO: 475 - DNA, 59 bp, Artificial Sequence
  Description of Artificial Sequence: Synthetic oligonucleotide
gttccattttactcccactccgacatccagatgacacagagccccagcagcctgagcgc

SEQ ID NO: 476 - DNA, 63 bp, Artificial Sequence
  Description of Artificial Sequence: Synthetic oligonucleotide
caacccctggacctttgggcagggaactaagctggagatcaagcgaactgtggctgcaccatc

SEQ ID NO: 477 - protein, 119 aa, Artificial Sequence
  Description of Artificial Sequence: Synthetic polypeptide
EVQLVESGGGLVQPGGSLRLSCAASGFTFSDFYMAWVRQAPGKGLEWVANINYDGSSTYYLDSLKSRFTISRDNAKNILYLQMNSLRAEDTAVYYCAREGDEGWYFDVWGQGTTVTVSS

SEQ ID NO: 478 - protein, 107 aa, Artificial Sequence
  Description of Artificial Sequence: Synthetic polypeptide
DIQMTQSPSSLSASVGDRVTITCKASQDVSTAVAWYQQKPGKAPKLLIYSASYRYTGVPSRFSGSGSGTDFTLTISSLQPEDFAVYYCQQHYSNPWTFGQGTKLEIK

SEQ ID NO: 479 - protein, 119 aa, Artificial Sequence
  Description of Artificial Sequence: Synthetic polypeptide
EVQLVESGGGLVQPGGSLRLSCAASGFTFSDFYMAWVRQAPGKGLEWVANINYDGSSTYYLDSLKSKFTISRDNAKNILYLQMQSLRAEDTAVYYCAREGDEGWYFDVWGQGTTVTVSS

SEQ ID NO: 480 - protein, 107 aa, Artificial Sequence
  Description of Artificial Sequence: Synthetic polypeptide
DIQMTQSPSSLSASVGDRVTITCKASQDVSTAVAWYQQKPGKAPKLLIYSASYRYTGVPDRFSGSGSGTDFTLTISSLQPEDFAVYYCQQHYSNPWTFGQGTKLEIK

SEQ ID NO: 481 - protein, 119 aa, Artificial Sequence
  Description of Artificial Sequence: Synthetic polypeptide
EVQLVESGGGLVQPGGSLRLSCAASGFTFSDFYMAWVRQAPGKGLEWVANINYDGSSTYYLDSLKSRFIISRDNAKNILYLQMSSLRAEDTAVYYCAREGDEGWYFDVWGQGTTVTVSS

SEQ ID NO: 482 - protein, 107 aa, Artificial Sequence; identical to SEQ ID NO: 480
  Description of Artificial Sequence: Synthetic polypeptide

SEQ ID NO: 483 - protein, 119 aa, Artificial Sequence
  Description of Artificial Sequence: Synthetic polypeptide
EVQLVESGGGLVQPGGSLRLSCTASGFTFSDFYMAWVRQAPGKGLEWVANINYDGSSTYYLDSLKSRFTISRDNAKNILYLQMNSLRAEDTAVYYCAREGDEGWYFDVWGQGTTVTVSS

SEQ ID NO: 484 - protein, 107 aa, Artificial Sequence
  Description of Artificial Sequence: Synthetic polypeptide
DIQMTQSPSSLSASVGDRVSITCKASQDVSTAVAWYQQKPGKAPKLLIYSASYRYTGVPSRFSGSGSGTDFTLTISSLQPEDFAVYYCQQHYSNPWTFGQGTKLEIK

SEQ ID NO: 485 - protein, 119 aa, Artificial Sequence
  Description of Artificial Sequence: Synthetic polypeptide
EVQLVESGGGLVQPGGSLRLSCAASGFTFSDFYMAWVRQAPGKGLEWVANINYDGSSTYYLDSLKSRFTISRDNAKNILYLQMQSLRAEDTAVYYCAREGDEGWYFDVWGQGTTVTVSS

SEQ ID NO: 486 - protein, 107 aa, Artificial Sequence
  Description of Artificial Sequence: Synthetic polypeptide
DIQMTQSPSSLSASVGDRVTITCKASQDVSTAVAWYQQKPGKAPKLLIYSASYRYTGVPSRFSGSGSGTDFTLTISSLQPEDFATYYCQQHYSNPWTFGQGTKLEIK

SEQ ID NO: 487 - protein, 119 aa, Artificial Sequence
  Description of Artificial Sequence: Synthetic polypeptide
EVQLVESGGGLVQPGGSLRLSCAASGFTFSDFYMAWVRQAPGKGLEWVANINYDGSSTYYLDSLKSRFTISRDNAKNSLYLQMNSLRAEDTAVYYCAREGDEGWYFDVWGQGTTVTVSS

SEQ ID NO: 488 - protein, 107 aa, Artificial Sequence
  Description of Artificial Sequence: Synthetic polypeptide
DIQMTQSPSSLSASVGDRVSITCKASQDVSTAVAWYQQKPGKAPKLLIYSASYRYTGVPDRFSGSGSGTDFTLTISSLQPEDFAVYYCQQHYSNPWTFGQGTKLEIK

SEQ ID NO: 489 - protein, 119 aa, Artificial Sequence
  Description of Artificial Sequence: Synthetic polypeptide
EVQLVESGGGLVQPGGSLRLSCAASGFTFSDFYMAWVRQAPGKGLEWVANINYDGSSTYYLDSLKSRFIISRDNAKNILYLQMNSLRAEDTAVYYCAREGDEGWYFDVWGQGTTVTVSS

SEQ ID NO: 490 - protein, 107 aa, Artificial Sequence
  Description of Artificial Sequence: Synthetic polypeptide
DIQMTQSPSSLSASVGDRVTITCKASQDVSTAVAWYQQKPGKAPKLLIYSASYRYTGVPDRFSGSGSGTDFTLTISSLQPEDFATYYCQQHYSNPWTFGQGTKLEIK

SEQ ID NO: 491 - protein, 119 aa, Artificial Sequence
  Description of Artificial Sequence: Synthetic polypeptide
EVQLVESGGGLVQPGGSLRLSCAASGFTFSDFYMAWVRQAPGKGLEWVANINYDGSSTYYLDSLKSRFTISRDNAKNSLYLQMQSLRAEDTAVYYCAREGDEGWYFDVWGQGTTVTVSS

SEQ ID NO: 492 - protein, 107 aa, Artificial Sequence
  Description of Artificial Sequence: Synthetic polypeptide
DIQMTQSPSSLSASVGDRVSITCKASQDVSTAVAWYQQKPGKAPKLLIYSASYRYTGVPDRFSGSGSGTDFTLTISSLQPEDFATYYCQQHYSNPWTFGQGTKLEIK

SEQ ID NO: 493 - protein, 119 aa, Artificial Sequence
  Description of Artificial Sequence: Synthetic polypeptide
EVQLVESGGGLVQPGGSLRLSCAASGFTFSDFYMAWVRQAPGKGLEWVANINYDGSSTYYLDSLKSRFTISRDNAKNILYLQMSSLRAEDTAVYYCAREGDEGWYFDVWGQGTTVTVSS

SEQ ID NO: 494 - protein, 107 aa, Artificial Sequence; identical to SEQ ID NO: 492
  Description of Artificial Sequence: Synthetic polypeptide

SEQ ID NO: 495 - protein, 119 aa, Artificial Sequence
  Description of Artificial Sequence: Synthetic polypeptide
EVQLVESGGGLVQPGGSLRLSCAASGFTFSDFYMAWVRQAPGKGLEWVANINYDGSSTYYLDSLKSRFIISRDNAKNILYLQMQSLRAEDTAVYYCAREGDEGWYFDVWGQGTTVTVSS

SEQ ID NO: 496 - protein, 107 aa, Artificial Sequence; identical to SEQ ID NO: 484
  Description of Artificial Sequence: Synthetic polypeptide

SEQ ID NO: 497 - protein, 11 aa, Artificial Sequence
  Description of Artificial Sequence: Synthetic peptide
RASQDVSTAVA

SEQ ID NO: 498 - protein, 11 aa, Artificial Sequence
  Description of Artificial Sequence: Synthetic peptide
KASQSVSTAVA

SEQ ID NO: 499 - protein, 12 aa, Artificial Sequence
  Description of Artificial Sequence: Synthetic peptide
KASQDIVSTAVA

SEQ ID NO: 500 - protein, 11 aa, Artificial Sequence
  Description of Artificial Sequence: Synthetic peptide
KASQDVSSAVA

SEQ ID NO: 501 - protein, 11 aa, Artificial Sequence
  Description of Artificial Sequence: Synthetic peptide
KASQDVSTALA

SEQ ID NO: 502 - protein, 7 aa, Artificial Sequence
  Description of Artificial Sequence: Synthetic peptide
AASYRYT

SEQ ID NO: 503 - protein, 7 aa, Artificial Sequence
  Description of Artificial Sequence: Synthetic peptide
SASSRYT

SEQ ID NO: 504 - protein, 7 aa, Artificial Sequence
  Description of Artificial Sequence: Synthetic peptide
SASYLYT

SEQ ID NO: 505 - protein, 7 aa, Artificial Sequence
  Description of Artificial Sequence: Synthetic peptide
SASYRQT

SEQ ID NO: 506 - protein, 7 aa, Artificial Sequence
  Description of Artificial Sequence: Synthetic peptide
SASYRYS

SEQ ID NO: 507 - protein, 10 aa, Artificial Sequence
  Description of Artificial Sequence: Synthetic peptide
GFTFSSFYMA

SEQ ID NO: 508 - protein, 11 aa, Artificial Sequence
  Description of Artificial Sequence: Synthetic peptide
GFTFSDFYYMA

SEQ ID NO: 509 - protein, 10 aa, Artificial Sequence
  Description of Artificial Sequence: Synthetic peptide
GFTFSDFWMA

SEQ ID NO: 510 - protein, 10 aa, Artificial Sequence
  Description of Artificial Sequence: Synthetic peptide
GFTFSDFYMS

SEQ ID NO: 511 - protein, 17 aa, Artificial Sequence
  Description of Artificial Sequence: Synthetic peptide
NIKYDGSSTYYLDSLKS

SEQ ID NO: 512 - protein, 17 aa, Artificial Sequence
  Description of Artificial Sequence: Synthetic peptide
NINQDGSSTYYLDSLKS

SEQ ID NO: 513 - protein, 17 aa, Artificial Sequence
  Description of Artificial Sequence: Synthetic peptide
NINYEGSSTYYLDSLKS

SEQ ID NO: 514 - protein, 17 aa, Artificial Sequence
  Description of Artificial Sequence: Synthetic peptide
NINYDISSTYYLDSLKS

SEQ ID NO: 515 - protein, 17 aa, Artificial Sequence
  Description of Artificial Sequence: Synthetic peptide
NINYDLSSTYYLDSLKS

SEQ ID NO: 516 - protein, 17 aa, Artificial Sequence
  Description of Artificial Sequence: Synthetic peptide
NINYDVSSTYYLDSLKS

SEQ ID NO: 517 - protein, 17 aa, Artificial Sequence
  Description of Artificial Sequence: Synthetic peptide
NINYDGSSKYYLDSLKS

SEQ ID NO: 518 - protein, 17 aa, Artificial Sequence
  Description of Artificial Sequence: Synthetic peptide
NINYDGSSTYYVDSLKS

SEQ ID NO: 519 - protein, 17 aa, Artificial Sequence
  Description of Artificial Sequence: Synthetic peptide
NINYDGSSKYYLESLKS

SEQ ID NO: 520 - protein, 17 aa, Artificial Sequence
  Description of Artificial Sequence: Synthetic peptide
NINYDGSSTYYLDILKS

SEQ ID NO: 521 - protein, 17 aa, Artificial Sequence
  Description of Artificial Sequence: Synthetic peptide
NINYDGSSTYYLDLLKS

SEQ ID NO: 522 - protein, 17 aa, Artificial Sequence
  Description of Artificial Sequence: Synthetic peptide
NINYDGSSTYYLDVLKS

SEQ ID NO: 523 - protein, 17 aa, Artificial Sequence
  Description of Artificial Sequence: Synthetic peptide
NINYDGSSTYYLDSVKS

SEQ ID NO: 524 - protein, 17 aa, Artificial Sequence
  Description of Artificial Sequence: Synthetic peptide
NINYDGSSTYYLDSLKG

SEQ ID NO: 525 - protein, 119 aa, Artificial Sequence
  Description of Artificial Sequence: Synthetic polypeptide
EVQLVESGGGLVQPGGSLRLSCAASGFTFSDFYMSWVRQAPGKGLEWVANINYDASSKYYVESLKSRFTISRDNAKNILYLQMNSLRAEDTAVYYCAREGDEGWYFDVWGQGTTVTVSS

SEQ ID NO: 526 - protein, 107 aa, Artificial Sequence
  Description of Artificial Sequence: Synthetic polypeptide
DIQMTQSPSSLSASVGDRVTITCKASQDISSAVAWYQQKPGKAPKLLIYSASYLYTGVPSRFSGSGSGTDFTLTISSLQPEDFAVYYCQQHYSNPWTFGQGTKLEIK

SEQ ID NO: 527 - protein, 119 aa, Artificial Sequence; identical to SEQ ID NO: 40
  Description of Artificial Sequence: Synthetic polypeptide

SEQ ID NO: 528 - protein, 107 aa, Artificial Sequence
  Description of Artificial Sequence: Synthetic polypeptide
DIQMTQSPSSLSASVGDRVTITCRASQDVSTAVAWYQQKPGKAPKLLIYAASYLYSGVPSRFSGSGSGTDFTLTISSLQPEDFAVYYCQQHYSNPWTFGQGTKLEIK

SEQ ID NO: 529 - protein, 119 aa, Artificial Sequence
  Description of Artificial Sequence: Synthetic polypeptide
EVQLVESGGGLVQPGGSLRLSCAASGFTFSDFYMSWVRQAPGKGLEWVANINYDASSKYYLESVKSRFTISRDNAKNILYLQMNSLRAEDTAVYYCAREGDEGWYFDVWGQGTTVTVSS

SEQ ID NO: 530 - protein, 107 aa, Artificial Sequence
  Description of Artificial Sequence: Synthetic polypeptide
DIQMTQSPSSLSASVGDRVTITCRASQDISTAVAWYQQKPGKAPKLLIYAASYLQSGVPSRFSGSGSGTDFTLTISSLQPEDFAVYYCQQHYSNPWTFGQGTKLEIK

SEQ ID NO: 531 - protein, 119 aa, Artificial Sequence
  Description of Artificial Sequence: Synthetic polypeptide
EVQLVESGGGLVQPGGSLRLSCAASGFTFSDFYMSWVRQAPGKGLEWVANINYEGSSKYYLDSLKSRFTISRDNAKNILYLQMNSLRAEDTAVYYCAREGDEGWYFDVWGQGTTVTVSS

SEQ ID NO: 532 - protein, 107 aa, Artificial Sequence
  Description of Artificial Sequence: Synthetic polypeptide
DIQMTQSPSSLSASVGDRVTITCKASQDVSSAVAWYQQKPGKAPKLLIYAASYRQSGVPSRFSGSGSGTDFTLTISSLQPEDFAVYYCQQHYSNPWTFGQGTKLEIK

SEQ ID NO: 533 - protein, 119 aa, Artificial Sequence; identical to SEQ ID NO: 525
  Description of Artificial Sequence: Synthetic polypeptide

SEQ ID NO: 534 - protein, 107 aa, Artificial Sequence
  Description of Artificial Sequence: Synthetic polypeptide
DIQMTQSPSSLSASVGDRVTITCRASQDISTAVAWYQQKPGKAPKLLIYAASSRQTGVPSRFSGSGSGTDFTLTISSLQPEDFAVYYCQQHYSNPWTFGQGTKLEIK

SEQ ID NO: 535 - protein, 119 aa, Artificial Sequence
  Description of Artificial Sequence: Synthetic polypeptide
EVQLVESGGGLVQPGGSLRLSCAASGFTFSDFYMSWVRQAPGKGLEWVANINYDASSKYYVESLKGRFTISRDNAKNILYLQMNSLRAEDTAVYYCAREGDEGWYFDVWGQGTTVTVSS

SEQ ID NO: 536 - protein, 107 aa, Artificial Sequence
  Description of Artificial Sequence: Synthetic polypeptide
DIQMTQSPSSLSASVGDRVTITCKASQSVSTALAWYQQKPGKAPKLLIYSASYRYTGVPSKFSGSGSGTDFTLTIISLQPEDFAVYYCQQHYSNPWTFGQGTKLEIK

SEQ ID NO: 537 - protein, 119 aa, Artificial Sequence
  Description of Artificial Sequence: Synthetic polypeptide
EVQLVESGGGLVQPGGSLRLSCAASGFTFSDFYMSWVRQAPGKGLEWVANINYEGSSKYYLESVKGRFTISRDNAKNILYLQMNSLRAEDTAVYYCAREGDEGWYFDVWGQGTTVTVSS

SEQ ID NO: 538 - protein, 107 aa, Artificial Sequence
  Description of Artificial Sequence: Synthetic polypeptide
DIQMTQSPSSLSASVGDRVTITCKASQDVSTALAWYQQKPGKAPKLLIYSASSRQSGVPSRFSGSGSGTDFTLTISSLQPEDFAVYYCQQHYSNPWTFGQGTKLEIK

SEQ ID NO: 539 - protein, 119 aa, Artificial Sequence
  Description of Artificial Sequence: Synthetic polypeptide
EVQLVESGGGLVQPGGSLRLSCAASGFTFSDFYMSWVRQAPGKGLEWVANINYDASSTYYVDSLKGRFTISRDNAKNILYLQMNSLRAEDTAVYYCAREGDEGWYFDVWGQGTTVTVSS

SEQ ID NO: 540 - protein, 107 aa, Artificial Sequence
  Description of Artificial Sequence: Synthetic polypeptide
DIQMTQSPSSLSASVGDRVTITCKASQDISTAVAWYQQKPGKAPKLLIYAASYLQTGVPSRFSGSGSGTDFTLTISSLQPEDFAVYYCQQHYSNPWTFGQGTKLEIK

SEQ ID NO: 541 - protein, 119 aa, Artificial Sequence; identical to SEQ ID NO: 20
  Description of Artificial Sequence: Synthetic polypeptide

SEQ ID NO: 542 - protein, 107 aa, Artificial Sequence
  Description of Artificial Sequence: Synthetic polypeptide
DIQMTQSPSSLSASVGDRVTITCRASQDVSSALAWYQQKPGKAPKLLIYAASYLYTGVPSRFSGSGSGTDFTLTISSLQPEDFAVYYCQQHYSNPWTFGQGTKLEIK

SEQ ID NO: 543 - protein, 119 aa, Artificial Sequence
  Description of Artificial Sequence: Synthetic polypeptide
EVQLVESGGGLVQPGGSLRLSCAASGFTFSDFYMAWVRQAPGKGLEWVANINYEGSSKYYVDSLKGRFTISRDNAKNILYLQMNSLRAEDTAVYYCAREGDEGWYFDVWGQGTTVTVSS

SEQ ID NO: 544 - protein, 107 aa, Artificial Sequence
  Description of Artificial Sequence: Synthetic polypeptide
DIQMTQSPSSLSASVGDRVTITCRASQDVSTAVAWYQQKPGKAPKLLIYSASSRQSGVPSRFSGSGSGTDFTLTISSLQPEDFAVYYCQQHYSNPWTFGQGTKLEIK

SEQ ID NO: 545 - protein, 119 aa, Artificial Sequence
  Description of Artificial Sequence: Synthetic polypeptide
EVQLVESGGGLVQPGGSLRLSCAASGFTFSDFYMSWVRQAPGKGLEWVANINYDASSTYYVDSLKSRFTISRDNAKNILYLQMNSLRAEDTAVYYCAREGDEGWYFDVWGQGTTVTVSS

SEQ ID NO: 546 - protein, 107 aa, Artificial Sequence
  Description of Artificial Sequence: Synthetic polypeptide
DIQMTQSPSSLSASVGDRVTITCKASQDVSSALAWYQQKPGKAPKLLIYSASYRYSGVPSRFSGSGSGTDFTLTISSLQPEDFAVYYCQQHYSNPWTFGQGTKLEIK

SEQ ID NO: 547 - protein, 119 aa, Artificial Sequence; identical to SEQ ID NO: 531
  Description of Artificial Sequence: Synthetic polypeptide

SEQ ID NO: 548 - protein, 107 aa, Artificial Sequence
  Description of Artificial Sequence: Synthetic polypeptide
DIQMTQSPSSLSASVGDRVTITCRASQSVSTAVAWYQQKPGKAPKLLIYSASSLQTGVPSRFSGSGSGTDFTLTISSLQPEDFAVYYCQQHYSNPWTFGQGTKLEIK

SEQ ID NO: 549 - protein, 119 aa, Artificial Sequence
  Description of Artificial Sequence: Synthetic polypeptide
EVQLVESGGGLVQPGGSLRLSCAASGFTFSDFYMSWVRQAPGKGLEWVANINYEGSSTYYLDSLKSRFTISRDNAKNILYLQMNSLRAEDTAVYYCAREGDEGWYFDVWGQGTTVTVSS

SEQ ID NO: 550 - protein, 107 aa, Artificial Sequence
  Description of Artificial Sequence: Synthetic polypeptide
DIQMTQSPSSLSASVGDRVTITCKASQDISTALAWYQQKPGKAPKLLIYSASYLYTGVPSRFSGSGSGTDFTLTISSLQPEDFAVYYCQQHYSNPWTFGQGTKLEIK

SEQ ID NO: 551 - protein, 119 aa, Artificial Sequence; identical to SEQ ID NO: 545
  Description of Artificial Sequence: Synthetic polypeptide

SEQ ID NO: 552 - protein, 107 aa, Artificial Sequence
  Description of Artificial Sequence: Synthetic polypeptide
DIQMTQSPSSLSASVGDRVTITCKASQDVSSAVAWYQQKPGKAPKLLIYSASYLQSGVPSRFSGSGSGTDFTLTISSLQPEDFAVYYCQQHYSNPWTFGQGTKLEIK

SEQ ID NO: 553 - protein, 119 aa, Artificial Sequence
  Description of Artificial Sequence: Synthetic polypeptide
EVQLVESGGGLVQPGGSLRLSCAASGFTFSDFYMSWVRQAPGKGLEWVANINYDASSTYYLDSLKGRFTISRDNAKNILYLQMNSLRAEDTAVYYCAREGDEGWYFDVWGQGTTVTVSS

SEQ ID NO: 554 - protein, 107 aa, Artificial Sequence
  Description of Artificial Sequence: Synthetic polypeptide
DIQMTQSPSSLSASVGDRVTITCKASQDISTALAWYQQKPGKAPKLLIYAASYLQSGVPSRFSGSGSGTDFTLTISSLQPEDFAVYYCQQHYSNPWTFGQGTKLEIK

SEQ ID NO: 555 - protein, 119 aa, Artificial Sequence; identical to SEQ ID NO: 20
  Description of Artificial Sequence: Synthetic polypeptide

SEQ ID NO: 556 - protein, 107 aa, Artificial Sequence; identical to SEQ ID NO: 25
  Description of Artificial Sequence: Synthetic polypeptide

SEQ ID NO: 557 - protein, 119 aa, Artificial Sequence
  Description of Artificial Sequence: Synthetic polypeptide
EVQLVESGGGLVQPGGSLRLSCAASGFTFSDFYMSWVRQAPGKGLEWVANINYEGSSTYYVDSVKGRFTISRDNAKNILYLQMNSLRAEDTAVYYCAREGDEGWYFDVWGQGTTVTVSS

SEQ ID NO: 558 - protein, 107 aa, Artificial Sequence
  Description of Artificial Sequence: Synthetic polypeptide
DIQMTQSPSSLSASVGDRVTITCRASQDISTAVAWYQQKPGKAPKLLIYSASYRYTGVPSRFSGSGSGTDFTLTISSLQPEDFAVYYCQQHYSNPWTFGQGTKLEIK

SEQ ID NO: 559 - protein, 119 aa, Artificial Sequence
  Description of Artificial Sequence: Synthetic polypeptide
EVQLVESGGGLVQPGGSLRLSCAASGFTFSDFYMSWVRQAPGKGLEWVANINYEGSSKYYVDSLKGRFTISRDNAKNILYLQMNSLRAEDTAVYYCAREGDEGWYFDVWGQGTTVTVSS

SEQ ID NO: 560 - protein, 107 aa, Artificial Sequence
  Description of Artificial Sequence: Synthetic polypeptide
DIQMTQSPSSLSASVGDRVTITCRASQSVSTALAWYQQKPGKAPKLLIYAASSRYSGVPSRFSGSGSGTDFTLTISSLQPEDFAVYYCQQHYSNPWTFGQGTKLEIK

SEQ ID NO: 561 - protein, 119 aa, Artificial Sequence
  Description of Artificial Sequence: Synthetic polypeptide
EVQLVESGGGLVQPGGSLRLSCAASGFTFSDFYMSWVRQAPGKGLEWVANINYEGSSKYYLESVKSRFTISRDNAKNILYLQMNSLRAEDTAVYYCAREGDEGWYFDVWGQGTTVTVSS

SEQ ID NO: 562 - protein, 107 aa, Artificial Sequence
  Description of Artificial Sequence: Synthetic polypeptide
DIQMTQSPSSLSASVGDRVTITCRASQDISTAVAWYQQKPGKAPKLLIYSASYLYSGVPSRFSGSGSGTDFTLTISSLQPEDFAVYYCQQHYSNPWTFGQGTKLEIK

SEQ ID NO: 563 - protein, 119 aa, Artificial Sequence
  Description of Artificial Sequence: Synthetic polypeptide
EVQLVESGGGLVQPGGSLRLSCAASGFTFSDFYMSWVRQAPGKGLEWVANIQYEGSSKYYLDSLKGRFTISRDNAKNILYLQMNSLRAEDTAVYYCAREGDEGWYFDVWGQGTTVTVSS

SEQ ID NO: 564 - protein, 107 aa, Artificial Sequence; identical to SEQ ID NO: 35
  Description of Artificial Sequence: Synthetic polypeptide

SEQ ID NO: 565 - protein, 119 aa, Artificial Sequence; identical to SEQ ID NO: 30
  Description of Artificial Sequence: Synthetic polypeptide

SEQ ID NO: 566 - protein, 107 aa, Artificial Sequence; identical to SEQ ID NO: 35
  Description of Artificial Sequence: Synthetic polypeptide

SEQ ID NO: 567 - protein, 119 aa, Artificial Sequence; identical to SEQ ID NO: 40
  Description of Artificial Sequence: Synthetic polypeptide

SEQ ID NO: 568 - protein, 107 aa, Artificial Sequence; identical to SEQ ID NO: 35
  Description of Artificial Sequence: Synthetic polypeptide

SEQ ID NO: 569 - protein, 119 aa, Artificial Sequence; identical to SEQ ID NO: 40
  Description of Artificial Sequence: Synthetic polypeptide

SEQ ID NO: 570 - protein, 107 aa, Artificial Sequence
  Description of Artificial Sequence: Synthetic polypeptide
DIQMTQSPSSLSASVGDRVTITCRASQDISTALAWYQQKPGKAPKLLIYSASYRQTGVPSRFSGSGSGTDFTLTISSLQPEDFAVYYCQQHYSNPWTFGQGTKLEIK

SEQ ID NO: 571 - protein, 119 aa, Artificial Sequence; identical to SEQ ID NO: 40
  Description of Artificial Sequence: Synthetic polypeptide

SEQ ID NO: 572 - protein, 107 aa, Artificial Sequence; identical to SEQ ID NO: 45
  Description of Artificial Sequence: Synthetic polypeptide

SEQ ID NO: 573 - protein, 119 aa, Artificial Sequence; identical to SEQ ID NO: 40
  Description of Artificial Sequence: Synthetic polypeptide

SEQ ID NO: 574 - protein, 107 aa, Artificial Sequence
  Description of Artificial Sequence: Synthetic polypeptide
DIQMTQSPSSLSASVGDRVTITCKASQSVSTAVAWYQQKPGKAPKLLIYAASSLQSGVPSRFSGSGSGTDFTLTISSLQPEDFAVYYCQQHYSNPWTFGQGTKLEIK

SEQ ID NO: 575 - protein, 119 aa, Artificial Sequence; identical to SEQ ID NO: 40
  Description of Artificial Sequence: Synthetic polypeptide

SEQ ID NO: 576 - protein, 107 aa, Artificial Sequence
  Description of Artificial Sequence: Synthetic polypeptide
DIQMTQSPSSLSASVGDRVTITCRASQDISTAVAWYQQKPGKAPKLLIYSASSLQSGVPSRFSGSGSGTDFTLTISSLQPEDFAVYYCQQHYSNPWTFGQGTKLEIK

SEQ ID NO: 577 - protein, 119 aa, Artificial Sequence; identical to SEQ ID NO: 40
  Description of Artificial Sequence: Synthetic polypeptide

SEQ ID NO: 578 - protein, 107 aa, Artificial Sequence
  Description of Artificial Sequence: Synthetic polypeptide
DIQMTQSPSSLSASVGDRVTITCKASQSISTAVAWYQQKPGKAPKLLIYAASSRQTGVPSRFSGSGSGTDFTLTISSLQPEDFAVYYCQQHYSNPWTFGQGTKLEIK

SEQ ID NO: 579 - protein, 119 aa, Artificial Sequence; identical to SEQ ID NO: 40
  Description of Artificial Sequence: Synthetic polypeptide

SEQ ID NO: 580 - protein, 107 aa, Artificial Sequence; identical to SEQ ID NO: 55
  Description of Artificial Sequence: Synthetic polypeptide

SEQ ID NO: 581 - protein, 119 aa, Artificial Sequence; identical to SEQ ID NO: 40
  Description of Artificial Sequence: Synthetic polypeptide

SEQ ID NO: 582 - protein, 107 aa, Artificial Sequence
  Description of Artificial Sequence: Synthetic polypeptide
DIQMTQSPSSLSASVGDRVTITCKASQDISTALAWYQQKPGKAPKLLIYAASYLYSGVPSRFSGSGSGTDFTLTISSLQPEDFAVYYCQQHYSNPWTFGQGTKLEIK

SEQ ID NO: 583 - protein, 119 aa, Artificial Sequence; identical to SEQ ID NO: 40
  Description of Artificial Sequence: Synthetic polypeptide

SEQ ID NO: 584 - protein, 107 aa, Artificial Sequence
  Description of Artificial Sequence: Synthetic polypeptide
DIQMTQSPSSLSASVGDRVTITCRASQSISTALAWYQQKPGKAPKLLIYSASSLQTGVPSRFSGSGSGTDFTLTISSLQPEDFAVYYCQQHYSNPWTFGQGTKLEIK

SEQ ID NO: 585 - protein, 119 aa, Artificial Sequence; identical to SEQ ID NO: 40
  Description of Artificial Sequence: Synthetic polypeptide

SEQ ID NO: 586 - protein, 107 aa, Artificial Sequence
  Description of Artificial Sequence: Synthetic polypeptide
DIQMTQSPSSLSASVGDRVTITCRASQDISTALAWYQQKPGKAPKLLIYSASYLQSGVPSRFSGSGSGTDFTLTISSLQPEDFAVYYCQQHYSNPWTFGQGTKLEIK

SEQ ID NO: 587 - protein, 119 aa, Artificial Sequence; identical to SEQ ID NO: 40
  Description of Artificial Sequence: Synthetic polypeptide

SEQ ID NO: 588 - protein, 107 aa, Artificial Sequence
  Description of Artificial Sequence: Synthetic polypeptide
DIQMTQSPSSLSASVGDRVTITCKASQSISTALAWYQQKPGKAPKLLIYSASYLQSGVPSRFSGSGSGTDFTLTISSLQPEDFAVYYCQQHYSNPWTFGQGTKLEIK

SEQ ID NO: 589 - protein, 119 aa, Artificial Sequence; identical to SEQ ID NO: 40
  Description of Artificial Sequence: Synthetic polypeptide

SEQ ID NO: 590 - protein, 107 aa, Artificial Sequence; identical to SEQ ID NO: 530
  Description of Artificial Sequence: Synthetic polypeptide

SEQ ID NO: 591 - protein, 119 aa, Artificial Sequence; identical to SEQ ID NO: 20
  Description of Artificial Sequence: Synthetic polypeptide

SEQ ID NO: 592 - protein, 107 aa, Artificial Sequence; identical to SEQ ID NO: 35
  Description of Artificial Sequence: Synthetic polypeptide

SEQ ID NO: 593 - protein, 119 aa, Artificial Sequence; identical to SEQ ID NO: 20
  Description of Artificial Sequence: Synthetic polypeptide

SEQ ID NO: 594 - protein, 107 aa, Artificial Sequence; identical to SEQ ID NO: 45
  Description of Artificial Sequence: Synthetic polypeptide

SEQ ID NO: 595 - protein, 119 aa, Artificial Sequence; identical to SEQ ID NO: 20
  Description of Artificial Sequence: Synthetic polypeptide

SEQ ID NO: 596 - protein, 107 aa, Artificial Sequence; identical to SEQ ID NO: 55
  Description of Artificial Sequence: Synthetic polypeptide

SEQ ID NO: 597 - protein, 119 aa, Artificial Sequence; identical to SEQ ID NO: 561
  Description of Artificial Sequence: Synthetic polypeptide

SEQ ID NO: 598 - protein, 107 aa, Artificial Sequence
  Description of Artificial Sequence: Synthetic polypeptide
DIQMTQSPSSLSASVGDRVTITCRASQSVSTALAWYQQKPGKAPKLLIYAASYLYTGVPSRFSGSGSGTDFTLTISSLQPEDFAVYYCQQHYSNPWTFGQGTKLEIK

SEQ ID NO: 599 - protein, 119 aa, Artificial Sequence
  Description of Artificial Sequence: Synthetic polypeptide
EVQLVESGGGLVQPGGSLRLSCAASGFTFSDFYMSWVRQAPGKGLEWVANINYEGSSTYYVESVKGRFTISRDNAKNILYLQMNSLRAEDTAVYYCAREGDEGWYFDVWGQGTTVTVSS

SEQ ID NO: 600 - protein, 107 aa, Artificial Sequence; identical to SEQ ID NO: 586
  Description of Artificial Sequence: Synthetic polypeptide

SEQ ID NO: 601 - protein, 119 aa, Artificial Sequence
  Description of Artificial Sequence: Synthetic polypeptide
EVQLVESGGGLVQPGGSLRLSCAASGFTFSDFYMAWVRQAPGKGLEWVANINYEGSSKYYLESLKGRFTISRDNAKNILYLQMNSLRAEDTAVYYCAREGDEGWYFDVWGQGTTVTVSS

SEQ ID NO: 602 - protein, 107 aa, Artificial Sequence; identical to SEQ ID NO: 588
  Description of Artificial Sequence: Synthetic polypeptide

SEQ ID NO: 603 - protein, 118 aa, Artificial Sequence; identical to SEQ ID NO: 70
  Description of Artificial Sequence: Synthetic polypeptide

SEQ ID NO: 604 - protein, 112 aa, Artificial Sequence
  Description of Artificial Sequence: Synthetic polypeptide
EIVMTQSPLSLPVTPGEPASISCRSSQSLLYSNAYNHLDWYLQKPGQSPQLLIYAGSNRASGVPDRFSGSGSGTDFTLKISRVEAEDVGVYYCMQALQTPPTFGQGTKLEIK

SEQ ID NO: 605 - protein, 118 aa, Artificial Sequence; identical to SEQ ID NO: 70
  Description of Artificial Sequence: Synthetic polypeptide

SEQ ID NO: 606 - protein, 112 aa, Artificial Sequence; identical to SEQ ID NO: 95
  Description of Artificial Sequence: Synthetic polypeptide

SEQ ID NO: 607 - protein, 118 aa, Artificial Sequence; identical to SEQ ID NO: 80
  Description of Artificial Sequence: Synthetic polypeptide

SEQ ID NO: 608 - protein, 112 aa, Artificial Sequence; identical to SEQ ID NO: 75
  Description of Artificial Sequence: Synthetic polypeptide

SEQ ID NO: 609 - protein, 118 aa, Artificial Sequence; identical to SEQ ID NO: 100
  Description of Artificial Sequence: Synthetic polypeptide

SEQ ID NO: 610 - protein, 112 aa, Artificial Sequence; identical to SEQ ID NO: 604
  Description of Artificial Sequence: Synthetic polypeptide

SEQ ID NO: 611 - protein, 118 aa, Artificial Sequence; identical to SEQ ID NO: 80
  Description of Artificial Sequence: Synthetic polypeptide

SEQ ID NO: 612 - protein, 112 aa, Artificial Sequence; identical to SEQ ID NO: 604
  Description of Artificial Sequence: Synthetic polypeptide

SEQ ID NO: 613 - protein, 118 aa, Artificial Sequence; identical to SEQ ID NO: 100
  Description of Artificial Sequence: Synthetic polypeptide

SEQ ID NO: 614 - protein, 112 aa, Artificial Sequence; identical to SEQ ID NO: 75
  Description of Artificial Sequence: Synthetic polypeptide

SEQ ID NO: 615 - protein, 118 aa, Artificial Sequence; identical to SEQ ID NO: 80
  Description of Artificial Sequence: Synthetic polypeptide

SEQ ID NO: 616 - protein, 112 aa, Artificial Sequence; identical to SEQ ID NO: 95
  Description of Artificial Sequence: Synthetic polypeptide

SEQ ID NO: 617 - protein, 118 aa, Artificial Sequence; identical to SEQ ID NO: 100
  Description of Artificial Sequence: Synthetic polypeptide

SEQ ID NO: 618 - protein, 112 aa, Artificial Sequence; identical to SEQ ID NO: 95
  Description of Artificial Sequence: Synthetic polypeptide

SEQ ID NO: 619 - protein, 120 aa, Artificial Sequence
  Description of Artificial Sequence: Synthetic polypeptide
DVQLVESGGGLVHPGGSLRLSCAASTFTFANYIMSWVRQAPGKGLEWVSGITGSSTNTYYTDSVKGRFTISRDNSKNTLYLEMNSLRAEDTAVYYCAKHQLYPYYAMDVWGQGTTVTVSS

SEQ ID NO: 620 - protein, 108 aa, Artificial Sequence
  Description of Artificial Sequence: Synthetic polypeptide
EIVLTQSPGSLSLSPGERATLSCRASQPIDSYLAWYQQKPGQAPRLLIYGASTRATDIPDRFSGSGSGTEFTLTISSLQSEDFAVYYCQQYYDWPPVTFGGGTKVEIK

SEQ ID NO: 621 - protein, 119 aa, Artificial Sequence
  Description of Artificial Sequence: Synthetic polypeptide
DVQLVESGGGVVRPGESLTLSCAASGFTFSSYDMGWVRQAPGEGLEWVSGIRGSGGSTYYADSVKGRFTISRDSSKNTLYLQMNSLRAEDTAVYYCAKENNRHSFFEYWGLGTLVTVSS

SEQ ID NO: 622 - protein, 109 aa, Artificial Sequence
  Description of Artificial Sequence: Synthetic polypeptide
EIVLTQSPGTLSLSPGERATLSCRASQSVGYYLAWYQQKPGQAPRLLIYDASNRASGISDRFSGSGSGTEFTLTISRLEPEDFAVYYCQQYYNNWPPLTFGGGTKVEIK

SEQ ID NO: 623 - protein, 119 aa, Artificial Sequence; identical to SEQ ID NO: 133
  Description of Artificial Sequence: Synthetic polypeptide

SEQ ID NO: 624 - protein, 109 aa, Artificial Sequence; identical to SEQ ID NO: 137
  Description of Artificial Sequence: Synthetic polypeptide

SEQ ID NO: 625 - protein, 120 aa, Artificial Sequence
  Description of Artificial Sequence: Synthetic polypeptide
DVQLVESGGGVVRPGESLRLSCAASGFTFSSYAMSWVRQTPGEGLEWVSFISSGGAYTHYTDSVKGRFTISRDNSKNTLYLQMNSLRAEDTAVYYCAKEKEIWNAFFDYWGLGTLVTVSS

SEQ ID NO: 626 - protein, 108 aa, Artificial Sequence
  Description of Artificial Sequence: Synthetic polypeptide
EIVLTQSPATLNLSPGDRATLTCRASQTVGSKLAWYQQTSGQAPRLLIYDASSRATGIPDRFSGSGSGTEFTLTISSLEPEDFAVYVCQQYYDWPPLTFGGGTKVEIK

SEQ ID NO: 627 - protein, 119 aa, Artificial Sequence
  Description of Artificial Sequence: Synthetic polypeptide
DVQLVESGGGVVRPGESLRLSCAASGFTFSSYDMGWVRQAPGEGLEWVSGIRVSGGSTYYADSVKGRFTISRDSSNNTLYLQMNSLRAEDTALYYCAKENDRHSFFEYWGLGTLVTVSS

SEQ ID NO: 628 - protein, 109 aa, Artificial Sequence
  Description of Artificial Sequence: Synthetic polypeptide
EIVLTQSPGTLSLSPGERATLSCRASQSVGYYLAWYQQKPGQAPRLLIYDASDRATAIPDRFSGSGSGTEFTLTISRLEPEDFAVYYCQQYYNNWPPLTFGGGTKVEIK

SEQ ID NO: 629 - protein, 117 aa, Artificial Sequence; identical to SEQ ID NO: 106
  Description of Artificial Sequence: Synthetic polypeptide

SEQ ID NO: 630 - protein, 108 aa, Artificial Sequence; identical to SEQ ID NO: 110
  Description of Artificial Sequence: Synthetic polypeptide

SEQ ID NO: 631 - protein, 119 aa, Artificial Sequence
  Description of Artificial Sequence: Synthetic polypeptide
DVQLVESGGGVVRPGESLRLSCAASGFSFSSYAMNWVRQAPGKGLEWVSAISGSGGGTFYADSVKGRFTISRDNSKNTLYLQMNSLRAEDTAIYYCAKDPFGYGFFDSWGLGTLVTVSS

SEQ ID NO: 632 - protein, 107 aa, Artificial Sequence
  Description of Artificial Sequence: Synthetic polypeptide
EIVMTQSPATLSVSPGDRATLSCRASQTVGSKLAWYQQKPGQAPRLLIYAASSRATGIPDRFSGSGSGTDFTLTISSLEPEDFAVYYCQQYYNWPPAFGGGTKVEIK

SEQ ID NO: 633 - protein, 123 aa, Artificial Sequence
  Description of Artificial Sequence: Synthetic polypeptide
DVQLVESGGGVVRPGESLRLSCAASGFIFRNYAMTWVRQAPGEGLEWVSTIRSSGSGRTDTYYADSVKGRFTISRDSSNNTLYLQMNSLRAEDTAVYYCAKSGTFWDTFFDYWGLGTLVTVSS

SEQ ID NO: 634 - protein, 108 aa, Artificial Sequence
  Description of Artificial Sequence: Synthetic polypeptide
EIVLTQNPGTLNLSPGERATLTCRASQSAGRNLAWYQQKPGQTPRLLIYDVNTRATGIPDRFSGSGSGTEFNLTISSLQNEDFAVYYCQQYNNWPPLTFGGGTKVEIK

SEQ ID NO: 635 - protein, 116 aa, Artificial Sequence
  Description of Artificial Sequence: Synthetic polypeptide
DVQLVESGGSVVRPGESLRLSCAASGFPFSSYPMTWVRQAPGEGLEWVSSIRGSGDRIHYADSVKGRFTISKDSSNNTLYLQMNSLRAEDTAVYYCATGWNFFDYWGLGTLVTVSS

SEQ ID NO: 636 - protein, 108 aa, Artificial Sequence
  Description of Artificial Sequence: Synthetic polypeptide
EIVLTQSPGTLSLSPGERATLSCRASQTVATYLAWYQQKPGQAPRLLIYAAISRATGIPDRFSGSGSGTDFTLTITRLEPEDSAVYYCQQYKDWPPLTFGGGTKVEIK

SEQ ID NO: 637 - protein, 116 aa, Artificial Sequence
  Description of Artificial Sequence: Synthetic polypeptide
DVQLVESGGGVVRPGGSLRLSCAASGFPFSSYPMTWVRQAPGEGLEWVSSIRPIGDRIHYADSVKGRFTISRDSSNNTLYLQMNSLRAEDTAVYYCATGWNFFDYWGLGTLVTVSS

SEQ ID NO: 638 - protein, 108 aa, Artificial Sequence
  Description of Artificial Sequence: Synthetic polypeptide
EIVLTQSPGTLSLSPGERATLTCRASQTVATYLAWYQQKPGQAPRLLIYAAISRATGIPDRFIGSGSGTDFTLTINRLEPEDFAVYYCQQYKDWPPLTFGGGTKVEIK

SEQ ID NO: 639 - protein, 122 aa, Artificial Sequence
  Description of Artificial Sequence: Synthetic polypeptide
DVQLVESGGGVVRPGESLRLSCAASGFTFSSYDMSWVRQAPGEGLEWVSAISGSGDRIHYADSVKGRFTISRDNSKNTLYLQMNSLRAEDTAVYYCAKDLRYYSGSPVFDYWGLGTLVTVSS

SEQ ID NO: 640 - protein, 108 aa, Artificial Sequence
  Description of Artificial Sequence: Synthetic polypeptide
EIVLTQSPGTLSLSPGERAILSCRASQTVGSRLAWYQQKPGQAPRLLIYAASSRATGIPDRFSGSGSGTEFTLTISSLQSEDFAVYYCQQYYDWPPLTFGGGTKVEIK

SEQ ID NO: 641 - protein, 248 aa, Artificial Sequence
  Description of Artificial Sequence: Synthetic polypeptide
EIVLTQSPGSLSLSPGERATLSCRASQPIDSYLAWYQQKPGQAPRLLIYGASTRATDIPDRFSGSGSGTEFTLTISSLQSEDFAVYYCQQYYDWPPVTFGGGTKVEIKGGGGSGGGGSGGGGSGGGGSDVQLVESGGGLVHPGGSLRLSCAASTFTFANYIMSWVRQAPGKGLEWVSGITGSSTNTYYTDSVKGRFTISRDNSKNTLYLEMNSLRAEDTAVYYCAKHQLYPYYAMDVWGQGTTVTVSS

SEQ ID NO: 642 - protein, 248 aa, Artificial Sequence
  Description of Artificial Sequence: Synthetic polypeptide
EIVLTQSPGTLSLSPGERATLSCRASQSVGYYLAWYQQKPGQAPRLLIYDASNRASGISDRFSGSGSGTEFTLTISRLEPEDFAVYYCQQYYNNWPPLTFGGGTKVEIKGGGGSGGGGSGGGGSGGGGSDVQLVESGGGVVRPGESLTLSCAASGFTFSSYDMGWVRQAPGEGLEWVSGIRGSGGSTYYADSVKGRFTISRDSSKNTLYLQMNSLRAEDTAVYYCAKENNRHSFFEYWGLGTLVTVSS

SEQ ID NO: 643 - protein, 248 aa, Artificial Sequence; identical to SEQ ID NO: 141
  Description of Artificial Sequence: Synthetic polypeptide

SEQ ID NO: 644 - protein, 248 aa, Artificial Sequence
  Description of Artificial Sequence: Synthetic polypeptide
EIVLTQSPATLNLSPGDRATLTCRASQTVGSKLAWYQQTSGQAPRLLIYDASSRATGIPDRFSGSGSGTEFTLTISSLEPEDFAVYVCQQYYDWPPLTFGGGTKVEIKGGGGSGGGGSGGGGSGGGGSDVQLVESGGGVVRPGESLRLSCAASGFTFSSYAMSWVRQTPGEGLEWVSFISSGGAYTHYTDSVKGRFTISRDNSKNTLYLQMNSLRAEDTAVYYCAKEKEIWNAFFDYWGLGTLVTVSS

SEQ ID NO: 645 - protein, 248 aa, Artificial Sequence
  Description of Artificial Sequence: Synthetic polypeptide
EIVLTQSPGTLSLSPGERATLSCRASQSVGYYLAWYQQKPGQAPRLLIYDASDRATAIPDRFSGSGSGTEFTLTISRLEPEDFAVYYCQQYYNNWPPLTFGGGTKVEIKGGGGSGGGGSGGGGSGGGGSDVQLVESGGGVVRPGESLRLSCAASGFTFSSYDMGWVRQAPGEGLEWVSGIRVSGGSTYYADSVKGRFTISRDSSNNTLYLQMNSLRAEDTALYYCAKENDRHSFFEYWGLGTLVTVSS

SEQ ID NO: 646 - protein, 245 aa, Artificial Sequence; identical to SEQ ID NO: 114
  Description of Artificial Sequence: Synthetic polypeptide

SEQ ID NO: 647 - protein, 246 aa, Artificial Sequence
  Description of Artificial Sequence: Synthetic polypeptide
EIVMTQSPATLSVSPGDRATLSCRASQTVGSKLAWYQQKPGQAPRLLIYAASSRATGIPDRFSGSGSGTDFTLTISSLEPEDFAVYYCQQYYNWPPAFGGGTKVEIKGGGGSGGGGSGGGGSGGGGSDVQLVESGGGVVRPGESLRLSCAASGFSFSSYAMNWVRQAPGKGLEWVSAISGSGGGTFYADSVKGRFTISRDNSKNTLYLQMNSLRAEDTAIYYCAKDPFGYGFFDSWGLGTLVTVSS

SEQ ID NO: 648 - protein, 251 aa, Artificial Sequence
  Description of Artificial Sequence: Synthetic polypeptide
EIVLTQNPGTLNLSPGERATLTCRASQSAGRNLAWYQQKPGQTPRLLIYDVNTRATGIPDRFSGSGSGTEFNLTISSLQNEDFAVYYCQQYNNWPPLTFGGGTKVEIKGGGGSGGGGSGGGGSGGGGSDVQLVESGGGVVRPGESLRLSCAASGFIFRNYAMTWVRQAPGEGLEWVSTIRSSGSGRTDTYYADSVKGRFTISRDSSNNTLYLQMNSLRAEDTAVYYCAKSGTFWDTFFDYWGLGTLVTVSS

SEQ ID NO: 649 - protein, 244 aa, Artificial Sequence
  Description of Artificial Sequence: Synthetic polypeptide
EIVLTQSPGTLSLSPGERATLSCRASQTVATYLAWYQQKPGQAPRLLIYAAISRATGIPDRFSGSGSGTDFTLTITRLEPEDSAVYYCQQYKDWPPLTFGGGTKVEIKGGGGSGGGGSGGGGSGGGGSDVQLVESGGSVVRPGESLRLSCAASGFPFSSYPMTWVRQAPGEGLEWVSSIRGSGDRIHYADSVKGRFTISKDSSNNTLYLQMNSLRAEDTAVYYCATGWNFFDYWGLGTLVTVSS

SEQ ID NO: 650 - protein, 244 aa, Artificial Sequence
  Description of Artificial Sequence: Synthetic polypeptide
EIVLTQSPGTLSLSPGERATLTCRASQTVATYLAWYQQKPGQAPRLLIYAAISRATGIPDRFIGSGSGTDFTLTINRLEPEDFAVYYCQQYKDWPPLTFGGGTKVEIKGGGGSGGGGSGGGGSGGGGSDVQLVESGGGVVRPGGSLRLSCAASGFPFSSYPMTWVRQAPGEGLEWVSSIRPIGDRIHYADSVKGRFTISRDSSNNTLYLQMNSLRAEDTAVYYCATGWNFFDYWGLGTLVTVSS

SEQ ID NO: 651 - protein, 250 aa, Artificial Sequence
  Description of Artificial Sequence: Synthetic polypeptide
EIVLTQSPGTLSLSPGERAILSCRASQTVGSRLAWYQQKPGQAPRLLIYAASSRATGIPDRFSGSGSGTEFTLTISSLQSEDFAVYYCQQYYDWPPLTFGGGTKVEIKGGGGSGGGGSGGGGSGGGGSDVQLVESGGGVVRPGESLRLSCAASGFTFSSYDMSWVRQAPGEGLEWVSAISGSGDRIHYADSVKGRFTISRDNSKNTLYLQMNSLRAEDTAVYYCAKDLRYYSGSPVFDYWGLGTLVTVSS

SEQ ID NO: 652 - protein, 446 aa, Artificial Sequence
  Description of Artificial Sequence: Synthetic polypeptide
EVMLVESGGGLVQPGGSLRLSCTASGFTFSASAMSWVRQAPGKGLEWVAYISGGGGDTYYSSSVKGRFTISRDNAKNSLYLQMNSLRAEDTAVYYCARHSNVNYYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 653 - protein, 218 aa, Artificial Sequence
  Description of Artificial Sequence: Synthetic polypeptide
EIVLTQSPATLSLSPGERATMSCRASENIDTSGISFMNWYQQKPGQAPKLLIYVASNQGSGIPARFSGSGSGTDFTLTISRLEPEDFAVYYCQQSKEVPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 654 - protein, 446 aa, Artificial Sequence
  Description of Artificial Sequence: Synthetic polypeptide
EVMLVESGGGLVQPGGSLRLSCTASGFTFSASAMSWVRQAPGKGLEWVAYISGGGGDTYYSSSVKGRFTISRDNAKNSLYLQMNSLRAEDTAVYYCARHSNPNYYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 655 - protein, 218 aa, Artificial Sequence; identical to SEQ ID NO: 653
  Description of Artificial Sequence: Synthetic polypeptide

SEQ ID NO: 656 - protein, 446 aa, Artificial Sequence
  Description of Artificial Sequence: Synthetic polypeptide
EVMLVESGGGLVQPGGSLRLSCTASGFTFSKSAMSWVRQAPGKGLEWVAYISGGGGDTYYSSSVKGRFTISRDNAKNSLYLQMNSLRAEDTAVYYCARHSNVNYYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 657 - protein, 218 aa, Artificial Sequence
  Description of Artificial Sequence: Synthetic polypeptide
EIVLTQSPATLSLSPGERATMSCRASENIDVSGISFMNWYQQKPGQAPKLLIYVASNQGSGIPARFSGSGSGTDFTLTISRLEPEDFAVYYCQQSKEVPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 658 - protein, 446 aa, Artificial Sequence; identical to SEQ ID NO: 656
  Description of Artificial Sequence: Synthetic polypeptide

SEQ ID NO: 659 - protein, 218 aa, Artificial Sequence; identical to SEQ ID NO: 657
  Description of Artificial Sequence: Synthetic polypeptide

SEQ ID NO: 660 - protein, 446 aa, Artificial Sequence; identical to SEQ ID NO: 656
  Description of Artificial Sequence: Synthetic polypeptide

SEQ ID NO: 661 - protein, 218 aa, Artificial Sequence; identical to SEQ ID NO: 657
  Description of Artificial Sequence: Synthetic polypeptide

SEQ ID NO: 662 - DNA, 71 bp, Artificial Sequence
  Description of Artificial Sequence: Synthetic primer
gttccagatttcaattgctcatcggatggtgggaagatgaagacagatggtgcagcaacagtccgtttgat

SEQ ID NO: 663 - protein, 446 aa, Artificial Sequence
  Description of Artificial Sequence: Synthetic polypeptide
EVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 664 - protein, 722 aa, Artificial Sequence
  Description of Artificial Sequence: Synthetic polypeptide
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 665 - protein, 215 aa, Artificial Sequence
  Description of Artificial Sequence: Synthetic polypeptide
EIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 666 - protein, 291 aa, Artificial Sequence
  Description of Artificial Sequence: Synthetic polypeptide
EGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 667 - protein, 116 aa, Artificial Sequence
  Description of Artificial Sequence: Synthetic polypeptide
EVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSS

SEQ ID NO: 668 - protein, 108 aa, Artificial Sequence
  Description of Artificial Sequence: Synthetic polypeptide
EIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIK

SEQ ID NO: 669 - protein, 16 aa, Artificial Sequence
  Description of Artificial Sequence: Synthetic peptide
  MOD_RES (10)..(10): N or Q
RSSQSLLYSXGYNHLD

SEQ ID NO: 670 - protein, 6 aa, Artificial Sequence
  Description of Artificial Sequence: Synthetic peptide
QPIRSY

SEQ ID NO: 671 - protein, 9 aa, Artificial Sequence
  Description of Artificial Sequence: Synthetic peptide
YYNDWPPLT

SEQ ID NO: 672 - protein, 5 aa, Artificial Sequence
  Description of Artificial Sequence: Synthetic peptide
  MOD_RES (5)..(5): A or S
DFYMX

SEQ ID NO: 673 - protein, 6 aa, Artificial Sequence
  Description of Artificial Sequence: Synthetic peptide
  MOD_RES (1)..(1): N or Q
  MOD_RES (3)..(3): D or E
  MOD_RES (4)..(4): G or A
XYXXSS

SEQ ID NO: 674 - protein, 8 aa, Artificial Sequence
  Description of Artificial Sequence: Synthetic peptide
  MOD_RES (2)..(2): N or Q
  MOD_RES (4)..(4): D or E
  MOD_RES (5)..(5): G or A
  MOD_RES (8)..(8): T or K
IXYXXSSX

SEQ ID NO: 675 - protein, 8 aa, Artificial Sequence
  Description of Artificial Sequence: Synthetic peptide
GDEGWYFD

SEQ ID NO: 676 - protein, 12 aa, Artificial Sequence
  Description of Artificial Sequence: Synthetic peptide
AREGDEGWYFDV

SEQ ID NO: 677 - protein, 6 aa, Artificial Sequence
  Description of Artificial Sequence: Synthetic peptide
  MOD_RES (2)..(2): D or S
  MOD_RES (3)..(3): V or I
  MOD_RES (5)..(5): T or S
QXXSXA

SEQ ID NO: 678 - protein, 3 aa, Artificial Sequence
  Description of Artificial Sequence: Synthetic peptide
SAS

SEQ ID NO: 679 - protein, 3 aa, Artificial Sequence
  Description of Artificial Sequence: Synthetic peptide
AAS

SEQ ID NO: 680 - protein, 3 aa, Artificial Sequence
  Description of Artificial Sequence: Synthetic peptide
  MOD_RES (1)..(1): S or A
XAS

SEQ ID NO: 681 - protein, 15 aa, Artificial Sequence
  Description of Artificial Sequence: Synthetic peptide
  MOD_RES (8)..(8): N or Q
  MOD_RES (9)..(9): Y or I
IYYSGSTXXNPSLKS

SEQ ID NO: 682 - protein, 8 aa, Artificial Sequence
  Description of Artificial Sequence: Synthetic peptide
QSGGGSFQ

SEQ ID NO: 683 - protein, 12 aa, Artificial Sequence
  Description of Artificial Sequence: Synthetic peptide
ARDQSGGGSFQH

SEQ ID NO: 684 - protein, 11 aa, Artificial Sequence
  Description of Artificial Sequence: Synthetic peptide
  MOD_RES (7)..(7): N or Q
QSLLYSXGYNH

SEQ ID NO: 685 - protein, 3 aa, Artificial Sequence
  Description of Artificial Sequence: Synthetic peptide
LGS

SEQ ID NO: 686 - protein, 3 aa, Artificial Sequence
  Description of Artificial Sequence: Synthetic peptide
GGS

SEQ ID NO: 687 - protein, 3 aa, Artificial Sequence
  Description of Artificial Sequence: Synthetic peptide
  MOD_RES (1)..(1): L or G
XGS

SEQ ID NO: 688 - protein, 7 aa, Artificial Sequence
  Description of Artificial Sequence: Synthetic peptide
WGTEYFD

SEQ ID NO: 689 - protein, 11 aa, Artificial Sequence
  Description of Artificial Sequence: Synthetic peptide
AKTWGTEYFDY

SEQ ID NO: 690 - protein, 15 aa, Artificial Sequence
  Description of Artificial Sequence: Synthetic peptide
  MOD_RES (11)..(11): D or E
IRGSGTTYYAXSVKG

SEQ ID NO: 691 - protein, 11 aa, Artificial Sequence
  Description of Artificial Sequence: Synthetic peptide
  MOD_RES (7)..(7): N, R or S
  MOD_RES (8)..(8): N or S
RASQPIXXYLA

SEQ ID NO: 692 - protein, 6 aa, Artificial Sequence
  Description of Artificial Sequence: Synthetic peptide
  MOD_RES (4)..(4): N, R or S
  MOD_RES (5)..(5): N or S
QPIXXY

SEQ ID NO: 693 - protein, 3 aa, Artificial Sequence
  Description of Artificial Sequence: Synthetic peptide
SAS

SEQ ID NO: 694 - protein, 5 aa, Artificial Sequence
  Description of Artificial Sequence: Synthetic peptide
  MOD_RES (1)..(1): N or S
XYDMG

SEQ ID NO: 695 - protein, 7 aa, Artificial Sequence
  Description of Artificial Sequence: Synthetic peptide
  MOD_RES (6)..(6): N or S
GFTFSXY

SEQ ID NO: 696 - protein, 8 aa, Artificial Sequence
  Description of Artificial Sequence: Synthetic peptide
  MOD_RES (6)..(6): N or S
GFTFSXYD

SEQ ID NO: 697 - protein, 8 aa, Artificial Sequence
  Description of Artificial Sequence: Synthetic peptide
NNRHSFFE

SEQ ID NO: 698 - protein, 8 aa, Artificial Sequence
  Description of Artificial Sequence: Synthetic peptide
NERHSFFE

SEQ ID NO: 699 - protein, 8 aa, Artificial Sequence
  Description of Artificial Sequence: Synthetic peptide
  MOD_RES (2)..(2): N or E
NXRHSFFE

SEQ ID NO: 700 - protein, 16 aa, Artificial Sequence
  Description of Artificial Sequence: Synthetic peptide
  MOD_RES (12)..(12): D or E
IRGRGGSTYYAXSVKG

SEQ ID NO: 701 - protein, 12 aa, Artificial Sequence
  Description of Artificial Sequence: Synthetic peptide
AKENNRHSFFEY

SEQ ID NO: 702 - protein, 12 aa, Artificial Sequence
  Description of Artificial Sequence: Synthetic peptide
AKENERHSFFEY

SEQ ID NO: 703 - protein, 12 aa, Artificial Sequence
  Description of Artificial Sequence: Synthetic peptide
  MOD_RES (5)..(5): N or E
AKENXRHSFFEY

SEQ ID NO: 704 - protein, 3 aa, Artificial Sequence
  Description of Artificial Sequence: Synthetic peptide
DAS

The invention claimed is:

1. A bispecific and tetravalent binding molecule having two antigen binding sites that bind specifically to CD137 (4-1BB Ligand Receptor, 4-1BB) and two antigen binding sites that bind specifically to Fibroblast Activation Protein (FAP) wherein each antigen binding site that binds specifically to CD137 (4-1BB Ligand Receptor) is part of an immunoglobulin molecule comprising a heavy chain variable region comprising heavy chain complementarity determining regions (CDRs) comprising the amino acid sequences of SEQ ID NO:295 (CDR1), SEQ ID NO:18 (CDR2) and SEQ ID NO: 9 (CDR3) and a light chain variable region comprising light chain CDRs comprising the amino acid sequences of SEQ ID NO:22 (CDR1), SEQ ID NO:23 (CDR2) and SEQ ID NO:14 (CDR3); and
the antigen binding sites that bind specifically to Fibroblast Activation Protein (FAP) each comprise single chain variable fragments (scFvs) comprising heavy chain CDRs comprising the amino acid sequences of SEQ ID NO:333 (CDR1), SEQ ID NO:144 (CDR2) and SEQ ID NO:145 (CDR3) and light chain CDRs comprising the amino acid sequences of SEQ ID NO:138 (CDR1), SEQ ID NO:139 (CDR2) and SEQ ID NO:140 (CDR3).

2. The bispecific and tetravalent binding molecule of claim 1, wherein each of said scFvs has a VL-VH orientation from N-to C-terminus.

3. The bispecific and tetravalent binding molecule of claim 1, wherein each of said scFvs is fused to the C-terminus of a heavy chain of the immunoglobulin molecule.

4. The bispecific and tetravalent binding molecule of claim 1, wherein each of said immunoglobulin molecules is an IgG.

5. The bispecific and tetravalent binding molecule of claim 1, wherein each of said scFvs is fused to the immunoglobulin molecule by a peptide linker having a length of between 4 to 20 amino acids.

6. The bispecific and tetravalent binding molecule of claim 1 wherein each of said immunoglobulin molecules comprises a variable heavy chain comprising the amino acid sequence of SEQ ID NO.:20 and a variable light chain comprising the amino acid sequence of SEQ ID NO.:25.

7. The bispecific and tetravalent binding molecule of claim 1, wherein each of said scFvs comprises
a variable heavy chain comprising the amino acid sequence of SEQ ID NO.:142 and a variable light chain comprising the amino acid sequence of SEQ ID NO.: 146.

8. An immunoglobulin-like binding molecule comprising an immunoglobulin heavy chain fused to a scFv at its C-terminus comprising the amino acid sequence of SEQ ID NO:159, and a light chain comprising the amino acid sequence of SEQ ID NO:160.

9. A nucleic acid molecule comprising a polynucleotide sequence encoding at least one polypeptide of a bispecific and tetravalent binding molecule of claim 1, or an expression vector or expression vectors containing such a nucleic acid molecule.

10. A host cell containing a nucleic acid molecule of claim 9.

11. A method of production of a bispecific and tetravalent binding molecule of claim 1, comprising:
(i) cultivating the host cell containing a nucleic acid molecule encoding the binding molecule of claim 1 or multiple nucleic acid molecules or an expression vector or expression vectors containing such a nucleic acid molecule or nucleic acid molecules under conditions allowing expression of the bispecific and tetravalent binding molecule; and,
(ii) recovering the bispecific and tetravalent binding molecule.

12. A pharmaceutical composition, comprising a binding molecule of claim 1 together with a pharmaceutically acceptable carrier and optionally one or more further active ingredients.

13. A method of treatment of cancer comprising administering an effective amount of the bispecific and tetravalent binding molecule of claim 1 to a patient in need thereof.

14. The method of claim 13, wherein said method further comprises administering an effective amount of an anti-PD-1 antibody to said patient in need thereof.

15. A bispecific and tetravalent binding molecule having two antigen binding sites that bind specifically to CD137 (4-1BB Ligand Receptor, 4-1BB) and two antigen binding sites that bind specifically to Fibroblast Activation Protein (FAP), comprising two identical immunoglobulin heavy chains each fused to a single chain variable fragment (scFv) at its C-terminus, each comprising the amino acid sequence of SEQ ID NO:159, and two identical light chains, each comprising the amino acid sequence of SEQ ID NO:160.

16. A pharmaceutical composition comprising the bispecific and tetravalent binding molecule of claim 15 and a pharmaceutically acceptable carrier.

17. A nucleic acid molecule the comprising a polynucleotide sequence encoding at least one polypeptide of the bispecific and tetravalent binding molecule of claim 15 or an expression vector or expression vectors containing such a nucleic acid molecule.

18. A host cell containing the nucleic acid molecule of claim 17.

19. A method of production of the bispecific and tetravalent binding molecule of claim 15, comprising:
(i) cultivating the host cell containing a nucleic acid molecule encoding the immunoglobulin-like binding molecule of claim 15 or multiple nucleic acid molecules or an expression vector or expression vectors containing such a nucleic acid molecule or nucleic acid molecules under conditions allowing expression of the bispecific and tetravalent binding molecule; and
(ii) recovering the bispecific and tetravalent binding molecule.

20. A method of treatment of cancer comprising administering an effective amount of the pharmaceutical composition of claim 16 to a patient in need thereof.

21. The bispecific and tetravalent binding molecule of claim 2, wherein each of the two scFvs is fused to the C-terminus of a heavy chain of the immunoglobulin molecule.

22. A host cell comprising a nucleic acid molecule or multiple nucleic acid molecules comprising polynucleotide sequences encoding the immunoglobulin-like binding molecule of claim 8.

23. A host cell comprising a nucleic acid molecule or multiple nucleic acid molecules comprising polynucleotide sequences encoding the bispecific and tetravalent binding molecule of claim 15.

24. An immunoglobulin-like binding molecule comprising an immunoglobulin heavy chain fused to a scFv at its C-terminus having the amino acid sequence consisting of SEQ ID NO:159, and a light chain having the amino acid sequence consisting of SEQ ID NO:160.

25. A pharmaceutical composition, comprising the immunoglobulin-like binding molecule of claim 8 and a pharmaceutically acceptable carrier.

26. A pharmaceutical composition, comprising the immunoglobulin-like binding molecule of claim 24 and a pharmaceutically acceptable carrier.

27. The pharmaceutical composition of claim 16, wherein said pharmaceutical composition comprises one or more further active ingredients.

28. The pharmaceutical composition of claim 25, wherein said pharmaceutical composition comprises one or more further active ingredients.

29. The pharmaceutical composition of claim 26, wherein said pharmaceutical composition comprises one or more further active ingredients.

30. The pharmaceutical composition of claim 12, wherein said pharmaceutical composition is lyophilized.

31. The pharmaceutical composition of claim 16, wherein said pharmaceutical composition is lyophilized.

32. The pharmaceutical composition of claim 25, wherein said pharmaceutical composition is lyophilized.

33. The pharmaceutical composition of claim 26, wherein said pharmaceutical composition is lyophilized.

34. A nucleic acid molecule comprising a polynucleotide sequence encoding at least one polypeptide of the immunoglobulin-like binding molecule of claim 24 or an expression vector or expression vectors containing such a nucleic acid molecule.

35. A host cell comprising a nucleic acid molecule or multiple nucleic acid molecules comprising polynucleotide sequences encoding the immunoglobulin-like binding molecule of claim 24.

36. A method of production of the immunoglobulin-like binding molecule of claim 8, comprising:
(i) cultivating the host cell containing a nucleic acid molecule encoding the immunoglobulin-like binding molecule of claim 8 or multiple nucleic acid molecules or an expression vector or expression vectors containing such a nucleic acid molecule or nucleic acid molecules under conditions allowing expression of the immunoglobulin-like binding molecule; and
(ii) recovering the immunoglobulin-like binding molecule.

37. A method of production of the immunoglobulin-like binding molecule of claim 24, comprising:
(i) cultivating the host cell containing a nucleic acid molecule encoding the immunoglobulin-like binding molecule of claim 24 or multiple nucleic acid molecules or an expression vector or expression vectors containing such a nucleic acid molecule or nucleic acid molecules under conditions allowing expression of the immunoglobulin-like binding molecule; and
(ii) recovering the immunoglobulin-like binding molecule.

38. A bispecific and tetravalent binding molecule having two antigen binding sites that bind specifically to CD137 (4-1BB Ligand Receptor, 4-1BB) and two antigen binding sites that bind specifically to Fibroblast Activation Protein (FAP), comprising two identical immunoglobulin heavy chains each fused to a single chain variable fragment (scFv) at its C-terminus, each consisting of the amino acid sequence of SEQ ID NO:159, and two identical light chains, each consisting of the amino acid sequence of SEQ ID NO:160.

39. A pharmaceutical composition, comprising the bispecific and tetravalent binding molecule of claim 38 and a pharmaceutically acceptable carrier.

40. The pharmaceutical composition of claim 39, wherein said pharmaceutical composition comprises one or more further active ingredients.

41. The pharmaceutical composition of claim 39, wherein said pharmaceutical composition is lyophilized.

42. A method of production of the bispecific and tetravalent binding molecule of claim 38, comprising:
(i) cultivating a host cell containing a nucleic acid molecule encoding said bispecific and tetravalent binding molecule, or containing multiple nucleic acid molecules encoding said bispecific and tetravalent binding molecule, or containing an expression vector or expression vectors containing such a nucleic acid molecule or nucleic acid molecules, under conditions allowing expression of the bispecific and tetravalent binding molecule; and
(ii) recovering the bispecific and tetravalent binding molecule.

43. A method of treatment of cancer comprising administering an effective amount of the bispecific and tetravalent binding molecule of claim 15 to a patient in need thereof.

44. The method of claim 43, wherein said method further comprises administering an effective amount of an anti-PD-1 antibody to said patient in need thereof.

45. A method of treatment of cancer comprising administering an effective amount of the immunoglobulin-like binding molecule of claim 24 to a patient in need thereof.

46. The method of claim 45, wherein said method further comprises administering an effective amount of an anti-PD-1 antibody to said patient in need thereof.

47. A method of treatment of cancer comprising administering an effective amount of the bispecific and tetravalent binding molecule of claim 38 to a patient in need thereof.

48. The method of claim 47, wherein said method further comprises administering an effective amount of an anti-PD-1 antibody to said patient in need thereof.

* * * * *